(12) United States Patent
Charretier et al.

(10) Patent No.: US 9,551,020 B2
(45) Date of Patent: Jan. 24, 2017

(54) METHOD OF DETECTING AT LEAST ONE MECHANISM OF RESISTANCE TO CARBAPENEMS BY MASS SPECTROMETRY

(75) Inventors: Yannick Charretier, Courzieu (FR); Jean-Philippe Charrier, Tassin la Demi-Lune (FR); Christine Franceschi, Meximieux (FR); Gilles Zambardi, Chezeneuve (FR); Tiphaine Cecchini, Saint-Genis les Ollieres (FR); Elodie Degout-Charmette, Toussieux (FR)

(73) Assignee: BIOMERIEUX, INC., Durham, NC (US)

(*) Notice: Subject to any disclaimer, the term of this patent is extended or adjusted under 35 U.S.C. 154(b) by 0 days.

(21) Appl. No.: 14/111,083

(22) PCT Filed: Apr. 20, 2012

(86) PCT No.: PCT/EP2012/057323
§ 371 (c)(1),
(2), (4) Date: Oct. 10, 2013

(87) PCT Pub. No.: WO2012/143535
PCT Pub. Date: Oct. 26, 2012

(65) Prior Publication Data
US 2015/0031063 A1    Jan. 29, 2015

Related U.S. Application Data

(60) Provisional application No. 61/477,915, filed on Apr. 21, 2011.

(51) Int. Cl.
*C12Q 1/37* (2006.01)
*C12Q 1/04* (2006.01)
*G01N 33/68* (2006.01)

(52) U.S. Cl.
CPC .. *C12Q 1/04* (2013.01); *C12Q 1/37* (2013.01); *G01N 33/6848* (2013.01); *G01N 2333/948* (2013.01); *G01N 2333/976* (2013.01); *G01N 2333/986* (2013.01)

(58) Field of Classification Search
CPC ....... C12Q 1/04; C12Q 1/37; G01N 2333/948; G01N 2333/976; G01N 2333/986; G01N 33/6848
See application file for complete search history.

(56) References Cited

U.S. PATENT DOCUMENTS

| | | | |
|---|---|---|---|
| 9,074,236 B2* | 7/2015 | Stephenson, Jr. .. | G01N 33/6848 |
| 2004/0229283 A1 | 11/2004 | Gygi et al. | |
| 2007/0006950 A1 | 1/2007 | Okada et al. | |
| 2007/0269895 A1 | 11/2007 | Aebersold et al. | |
| 2012/0196309 A1* | 8/2012 | Peaper ..................... | C12Q 1/04 435/18 |
| 2012/0264156 A1 | 10/2012 | Beaulieu et al. | |
| 2015/0255261 A1* | 9/2015 | Stephenson, Jr. .. | G01N 33/6848 250/282 |

FOREIGN PATENT DOCUMENTS

| | | |
|---|---|---|
| WO | WO 2005/098071 A1 | 10/2005 |
| WO | WO 2006/128492 A1 | 12/2006 |
| WO | WO 2008/066629 A2 | 6/2008 |
| WO | WO 2008/145763 A1 | 12/2008 |
| WO | WO 2011/045544 A2 | 4/2011 |

OTHER PUBLICATIONS

ExPaSy peptidecutter for KPC-1—accessed online Jun. 8, 2015 at http://web.expasy.org/cgi-bin/peptide_cutter/peptidecutter.pl, 2 pages.*
Savini et al. Bacillus cereus heteroresistance to carbapenems in a cancer patient. J Hosp Infect 2009, pp. 288-289.*
Yigit et al. Novel Carbapenem-Hydrolyzing beta-lactamase, KPC-1, from a Carbapenem-Resistant Strain of Klebsiella pneumoniae. Antimicrobial Agents and Chemotherapy, 2001. vol. 45, No. 4, pp. 1151-1161.*
Yigit et al. Novel Carbapenem-Hydrolyzing beta-lactamase, KPC-1, from a Carbapenem-Resistant Strain of Klebsiella pneumoniae. Author's correction Antimicrobial Agents and Chemotherapy, 2008. vol. 52, No. 2, p. 809.*
Kulkami et al. Use of Impipenem to Detect KPC, NDM, OXA, IMP, and VIM Carbapenemase Activity from Gram-Negative Rods in 75 Minutes Using Liquid Chromatography-Tandem Mass Spectrometry. JCM Jul. 2014, vol. 52, No. 7, pp. 2500-2505.*
Anderson, L. et al. "Quantitative Mass Spectrometric Multiple Reaction Monitoring Assays for Major Plasma Proteins." Molecular & Cellular Proteomics, 2006, pp. 573-588, vol. 5, No. 4. The American Society for Biochemistry and Molecular Biology, Inc.
Anhalt, J. et al. "Identification of Bacteria Using Mass Spectrometry." Analytical Chemistry, Feb. 1975, pp. 219-225, vol. 47, No. 2.
Bernardo et al, "Identification and discrimination of *Staphylococcus aureus* strains using matrix-assisted laser desorption/ionization-time of flight mass spectrometry." Proteomics, 2002, pp. 747-753, 2(6).
Bernardo et al, "Identification of *Staphylococcus aureus* exotoxins by combined sodium dodecyl sulfate gel electrophoresis and matrix-assisted laser desorption/ionization-time of flight mass spectrometry." Proteomics, 2002, pp. 740-746, 2(6).
Brun, V. et al. "Isotope-labeled Protein Standards Toward Absolute Quantitative Proteomics." Molecular & Cellular Proteomics, 2007, pp. 2139-2149, vol. 6, No. 12, The American Society for Biochemistry and Molecular Biology, Inc.
Bundy, J. et al. "Lectin-Based Affinity Capture for MALDI-MS Analysis of Bacteria." Analytical Chemistry, Apr. 1999, pp. 1460-1463, vol. 71, No. 7, American Chemical Society.

(Continued)

*Primary Examiner* — Marcela M Cordero Garcia
(74) *Attorney, Agent, or Firm* — Oliff PLC

(57) ABSTRACT

The present invention pertains to a method of detection, by mass spectrometry, of at least one marker of at least one mechanism of resistance to at least one antimicrobial, resistance of at least one microorganism contained in a sample, characterised in that the antimicrobial is a carbapenem, and said resistance markers are proteins or peptides. Preferably, said proteins or peptides are proteins from said microorganism.

7 Claims, No Drawings

(56) References Cited

OTHER PUBLICATIONS

Bush, K. et al. "Updated Classification of β-Lactamases." Antimicrobial Agents and Chemotherapy, Mar. 2010, pp. 969-976, vol. 54, No. 3, American Society for Microbiology.
Camara et al, "Discrimination between wild-type and ampicillin-resistant *Escherichia coli* by matrix-assisted laser desorption/ionization time-of-flight mass spectrometry." Analytical and Bioanal. Chemistry, 2007, pp. 1633-1638, 389(5).
Carbonnelle et al, "Rapid identification of *Staphylococci* isolated in clinical microbiology laboratories by matrix-assisted laser desorption ionization-time of flight mass spectrometry", Journal of Clinical Microbio., 2007, pp. 2156-2161, 45(7).
Chen, W. et al. "Functional Nanoparticle-Based Proteomic Strategies for Characterization of Pathogenic Bacteria." Analytical Chemistry, Dec. 2008, pp. 9612-9621, vol. 80, No. 24, American Chemical Society.
Claydon, M. et al. "The rapid identification of intact microorganisms using mass spectrometry." Nature Biotechnology, Nov. 1996, pp. 1584-1586, vol. 14.
Dare et al, "Staphylococci speciation and Panton-Valentine leukocidin detection by matrix assisted laser desorption ionisation time-of-flight mass spectrometry", Intern. Journal of Antimicrobial Agents, 2007, pp. 103-104, 29(2).
Desiere, F. et al. "The PeptideAtlas project." Nucleic Acids Research, 2006, pp. D655-D658, vol. 34, Database Issue, Oxford University Press, Oxford, UK.
Ding, D. et al. "Identification of protein components and quantitative immunoassay for SEC2 in staphylococcin injection." Journal of Pharmaceutical and Biomedical Analysis, 2009, pp. 79-85, vol. 50.
Ecker, D. et al. "Ibis T5000: a universal biosensor approach for microbiology." Nature Reviews Microbiology, Jun. 2008, pp. 553-558, vol. 6, No. 7, Nature Publishing Group.
Everley, R. et al. "Characterization of *Clostridium* species utilizing liquid chromatography/mass spectrometry of intact proteins." Journal of Microbiological Methods, pp. 152-158, Feb. 2009, vol. 77.
Fenselau, C. et al. "Identification of β-Lactamase in Antibiotic-Resistant *Bacillus cereus* Spores." Applied and Environmental Microbiology. Feb. 2008, pp. 904-906, vol. 74, No. 3, American Society for Microbiology.
Fortfn, T. et al. "Clinical Quantitation of Prostate-specific Antigen Biomarker in the Low Nanogram/Milliliter Range by Conventional Bore Liquid Chromatography-Tandem Mass Spectrometry (Multiple Reaction Monitoring) Coupling and Correlation with ELISA Tests." Molecular & Cellular Proteomics, pp. 1006-1015, vol. 8, No. 5, The American Society for Biochemistry and Molecular Biology, Inc.
Fox, A. et al. ed., "Analytical Microbiology Methods: Chromatography and Mass Spectrometry." 1990, Plenum Press, New York, NY.
Fusaro, V. et al. "Prediction of high-responding peptides for targeted protein assays by mass spectrometry." Nature Biotechnology, Feb. 2009, pp. 190-198, vol. 27, No. 2, Nature America, Inc.
Gaskell, S. "Electrospray: Principles and Practice." Journal of Mass Spectrometry, 1997, pp. 677-688, vol. 32, John Wiley & Sons, Ltd.
Gröbner, S. et al. "Emergence of carbapenem-non-susceptible extended-spectrum β-lactamase-producing *Klebsiella pneumonia* isolates at the university hospital of Tübingen, Germany." Journal of Medical Microbiology, 2009, pp. 912-922, vol. 58, SGM.
Han, B. et al. "Proteomics: from hypothesis to quantitative assay on a single platform. Guidelines for developing MRM assays using ion trap mass spectrometers." Briefings in Functional Genomics and Proteomics, Jun. 2008, pp. 340-354, vol. 7, No. 5, Oxford University Press, Oxford, UK.
Hernychova, L. et al. "Detection and Identification of *Coxiella burnetii* Based on the Mass Spectrometric Analyses of the Extracted Proteins." Analytical Chemistry, Sep. 2008, pp. 7097-7104, vol. 80, No. 18, American Chemical Society.
Ho, K., et al, "Using Biofunctionalized Nanoparticles to Probe Pathogenic Bacteria", Anal. Chem., 2004, pp. 7162-7168, 76.
Hofstadler, S. et al. "TIGER: the universal biosensor." International Journal of Mass Spectrometry, 2005, pp. 23-41, vol. 242.
Keshishian, H. et al. "Quantitative, Multiplexed Assays for Low Abundance Proteins in Plasma by Targeted Mass Spectrometry and Stable Isotope Dilution." Molecular & Cellular Proteomics, 2007, pp. 2212-2229, vol. 6, No. 12, The American Society for Biochemistry and Molecular Biology, Inc.
Kondo, F., et al, "Identification of Shiga toxins in Shiga toxin-producing *Escherichia coli* using immunoprecipitation and high-performance liquid chromatography-electrospray ionization mass spectrometry." The Analyst, 2003, pp. 1360-1364, 128(11).
Krishnamurthy, T, et al. "Rapid Identification of Bacteria by Direct Matrix-assisted Laser Desorption/Ionization Mass Spectrometric Analysis of Whole Cells." Rapid Communications in Mass Spectrometry, 1996, pp. 1992-1996, vol. 18, John Wiley & Sons, Ltd.
Li, M., et al, "Comparative proteomic analysis to identification of extracellular virulence factors of enterohemorrhagic *Escherichia coli* (EHEC) and enteropathogenic *Escherichia coil* (EPEC)." Faseb Journal, 2005, A1388, 19(5).
Lin, Y.C. et al. "Differences in carbapenem resistance genes among *Acinetobacter baumannii*, *Acinetobacter* genospecies 3 and *Acinetobacter* genospecies 13TU in Taiwan." International Journal of Antimicrobial Agents, 2010, pp. 439-443, vol. 35.
Lin, Y.S. et al. "Affinity Capture Using Vancomycin-Bound Magnetic Nanoparticles for the MALDI-MS Analysis of Bacteria." Analytical Chemistry, Mar. 2005, pp. 1753-1760, vol. 77, No. 6, American Chemical Society.
López-Ferrer, D. et al. "Ultra Fast Trypsin Digestion of Proteins by High Intensity Focused Ultrasound." Journal of Proteome Research, 2005, pp. 1569-1574, vol. 4, American Chemical Society.
López-Ferrer, D. et al. "On-line Digestion System for Protein Characterization and Proteome Analysis." Analytical Chemistry, Dec. 2008, pp. 8930-8936, vol. 80, No. 23, American Chemical Society.
Mainardi, J. et al. "Resistance to cefotaxime and peptidoglycan composition in *Enterococcus faecalis* are influenced by exogenous sodium chloride." Microbiology, 1998, pp. 2679-2685, vol. 144, SGM.
Majcherczyk P., et al, "The discriminatory power of MALDI-TOF mass spectrometry to differentiate between isogenic teicoplanin-susceptible and teicoplanin-resistant strains of methicillin-resistant *Staphylococcus aureus*", Fems Microbiol Letters, 2006, pp. 233-239, 255(2).
Manes, N. et al. "Targeted Protein Degradation by *Salmonella* under Phagosome-mimicking Culture conditions Investigated Using Comparative Peptidomics." Molecular & Cellular Proteomics, Jan. 2007, pp. 717-727, vol. 6, No. 4, MCP Papers in Press.
Marinach, C. et al, "MALDI-TOF MS-based drug susceptibility testing of pathogens: The example of *Candida albicans* and fluconazole." Proteomics, 2009, pp. 4627-4631, 9(20).
Mazzeo, M., et al, "Matrix-assisted laser desorption ionization-time of flight mass spectrometry for the discrimination of food-borne microorganisms", Applied and Env. Microbio., 2006, pp. 1180-1189,72(2).
Mead, J. et al. "MRMaid, the Web-based Tool for Designing Multiple Reaction Monitoring (MRM) Transitions." Molecular & Cellular Proteomics, 2009, pp. 696-705, vol. 8, No. 4, The American Society for Biochemistry and Molecular Biology, Inc.
Melanson, J., et al, "Targeted comparative proteomics by liquid chromatography/matrix-assisted laser desorption/ionization triple-quadruple mass spectrometry." Rapid Communications in Mass Spectrometry, 2006, pp. 904-910, 20(5).
Nandakumar, R. et al. "Proteomic analysis of endodontic infections by liquid chromatography-tandem mass spectrometry." Oral Microbiology and Immunology, 2009, pp. 347-352, vol. 24, John Wiley & Sons, Ltd.
Pratt, J. et al. "Multiplexed absolute quantification for proteomics using concatenated signature peptides encoded by QconCAT genes." Nature Protocols, 2006, pp. 1029-1043, vol. 1, No. 2, Nature Publishing Group.
Qian, J., et al, "MALDI-TOF mass signatures for differentiation of yeast species, strain grouping and monitoring of morphogenesis markers", Analytical and Bioanal. Chemistry, 2008, pp. 439-449, 392(3).

(56) References Cited

OTHER PUBLICATIONS

Savinova, T.A. et al, abstract of "A mass-spectrometric analysis of genetic markers of *S. pneumonia* resistance to β-lactam antibiotics." XP00268431, Database accession No. NLM20882772, Database Medline, 2010, US National Library of Medicine, Bethesda, MD.
Seng, P. et al. "Ongoing Revolution in Bacteriology: Routine Identification of Bacteria by Matrix-Assisted Laser Desorption Ionization Time-of-Flight Mass Spectrometry." Clinical Infectious Diseases, Aug. 2009, pp. 543-551, vol. 49, Infectious Diseases Society of America.
Stahl-Zeng, J. et al. "High Sensitivity Detection of Plasma Proteins by Multiple Reaction Monitoring of N-Glycosites," Molecular & Cellular Proteomics, Jul. 2007, pp. 1809-1817, vol. 6, No. 10, The American Society for Biochemistry and Molecular Biology, Inc.
Takao, T., et al, "Identity of molecular structure of Shiga-like toxin 1 (VT1) from *Escherichia coli* 0157 : H7 with that of Shiga toxin." Microbial Pathogenesis, 1988, pp. 357-369, 5(5).
Teng, C.H. et al. "Gold Nanopanicles as Selective and Concentrating Probes for Samples in MALDI MS Analysis." Analytical Chemistry, Aug. 2004, pp. 4337-4342, vol. 76, No. 15, American Chemical Society.
Vaidyanathan, S. et al. "Discrimination of Aerobic Endospore-forming Bacteria via Electrospray-Ionization Mass Spectrometry of Whole Cell Suspensions." Analytical Chemistry, Sep. 2001, pp. 4134-4144, vol. 73, No. 17, American Chemical Society.
Wang, K.Y. et al. "Multiplexed Immunoassay: Quantitation and Profiling of Serum Biomarkers Using Magnetic Nanoprobes and MALDI-TOF MS." Analytical Chemistry, Aug. 2008, pp. 6159-6167, vol. 80, No. 16, American Chemical Society.
Wybo, I. et al. "Differentiation of *cfiA*-Negative and *cfiA*-Positive *Bacteroides fragilis* Isolates by Matrix-Assisted Laser Desorption Ionization—Time of Flight Mass Spectrometry." Journal of Clinical Microbiology, May 2011, pp. 1961-1964, vol. 49, No. 5, American Society for Microbiology.
Zheng, K. "Elucidation of peptide metabolism by on-line immunoaffinity liquid chromatography mass spectrometry." Rapid Communications in Mass Spectrometry, 2000, pp. 261-269, vol. 14, John Wiley & Sons, Ltd.
Written Opinion of the International Searching Authority for International Application No. PCT/EP2012/057323 (with English Translation).
Written Opinion of the International Searching Authority for International Application No. PCT/EP2012/057322 (with English Translation).
Written Opinion of the International Searching Authority for International Application No. PCT/FR2010/052181 (with English Translation).
U.S. Appl. No. 14/111,118 in the name of Charretier et al.
International Search Report issued in International Application No. PCT/EP2012/057322 (with English translation).
International Search Report issued in International Application No. PCT/EP2012/057323 (with English translation).
International Search Report issued in International Application No. PCT/FR2010/052181 (with English translation).
Sep. 4, 2014 Office Action issued in U.S. Appl. No. 14/111,118.
Jan. 3, 2014 Office Action issued in U.S. Appl. No. 13/502,020.
May 15, 2014 Office Action issued in U.S. Appl. No. 13/502,020.
Sauer, Sascha, et al., "Classification and Identification of Bacteria by Mass Spectrometry and Computational Analysis," vol. 3, Issue 7, Jul. 2008, pp. 1-10.
U.S. Appl. No. 13/502,020, filed Jun. 29, 2012 in the name of Beaulieu et al.
Apr. 24, 2015 Office Action issued in U.S. Appl. No. 14/111,118.
Ahmet et al., "Pyrolysis Mass Spectrometry of Cephalosporin-Resistant Enterobacter Cloacae," Journal of Hospital Infection, vol. 31, pp. 99-104, 1995.
Bush, "Extended-Spectrum Beta-Lactamases in North America,1987-2006," Clinical Microbiology and Infectious Diseases, vol. 14 (Supp) 1), pp. 134-143, 2008.
Hope et al., "Efficacy of Practised Screening Methods for Detection of Cephalosporin-Resistant Enterobacteriaceae," Journal of Antimicrobial Chemotherapy, vol. 59, pp. 110-113, 2007.
Moosdeen, "The Evolution of Resistance to Cephalosporins," Clinical Infectious Diseases, pp. 487-493, 1997.
Beccerril et al., "Combination of Analytical and Microbiological Techniques to Study the Antimicrobial Activity of a New Active Food Packaging Containing Cinnamon or Oregano Against *E. coli* and *S. aureus*," Anal Bioanal Chem, vol. 388, pp. 1003-1011, 2007.
Kuhn et al., "Quantification of C-Reactive Protein in the Serum of Patients with Rheumatoid Arthritis Using Multiple Reaction Monitoring Mass Spectrometry and 13C-Labeled Peptide Standards," Proteomics, vol. 4, pp. 1175-1186, 2004.
Keller et al., "A Uniform Proteomics MS/MS Analysis Platform Utilizing Open XML File Formats," Molecular Systems Biology, vol. 1, pp. 1-8, 2005.
Sep. 23, 2015 Office Action issued in U.S. Appl. No. 13/502,020.
Jan. 4, 2016 Office Action issued in U.S. Appl. No. 14/111,118.

* cited by examiner

METHOD OF DETECTING AT LEAST ONE MECHANISM OF RESISTANCE TO CARBAPENEMS BY MASS SPECTROMETRY

The present invention relates to the field of microbiology. More precisely, the invention relates to the detection of at least one mechanism of resistance to carbapenems of at least one microorganism from a sample by using mass spectrometry.

Since Pasteur's discovery of microbes, microorganisms have been studied by microscopy and biochemical analyses. These conventional methods are often long and tedious, and analytical alternatives were sought very early on. This is why the analysis of bacteria by mass spectrometry was initiated from 1975 by J. Anhalt and C. Fenselau [1].

This preliminary work was followed by the study of fatty acids from the wall of the microorganisms using gas chromatography combined with mass spectrometry (GC-MS) [2]. This method was popularised under the English term FAME, standing for Fatty Acid Methyl Ester. It currently constitutes a reference method for taxonomic studies. However, its use remains limited to certain specialised laboratories dealing with the treatment of the sample by saponification, hydrolysis and derivation.

In 1996, the works by M. Claydon et al. [3] as well as by T. Krishnamurthy and P. Ross [4] demonstrated the possibility of identifying different bacterial species with a MALDI-TOF mass spectrometer (English acronym for Matrix Assisted Laser Desorption Ionization—Time Of Flight). The analysis combines the acquisition of a mass spectrum and the interpretation of expert software. It is extremely simple and can be carried out in a few minutes. However it has only been making it into medical analysis laboratories fairly recently [5]. Its clinical use is currently limited to the identification of bacteria and yeast species. It is not routinely used to identify resistances to antimicrobials.

Yet the identification of resistances to antimicrobials such as antibiotics is an essential element in ensuring optimal patient care.

Other mass spectrometry methods, particularly in tandem, have been proposed to meet these needs. By way of example, it is possible to cite the work of C. Fenselau et al. for identifying β-Lactamase with a quadripole-TOF (Q-TOF) [6].

However these research results are not applicable to routine clinical use. They were obtained with research instruments requiring highly qualified personnel. The analysis times, often greater than one hour per sample, are incompatible with the workload of a microbiological analysis laboratory.

More recently, S. Hofstadler et al. [7] proposed a method combining a microbial genome amplification by PCR to a detection of the PCR products by electrospray-TOF (ESI-TOF). This method is now fully automated [8]. However, it requires a PCR amplification with the flaws inherent in molecular biology, namely extraction yield, cost of the probes, etc.

In this context, the objective of the present invention is to propose a method of detecting mechanisms of resistance to carbapenems which makes it possible to overcome the disadvantages of the prior art methods, namely providing an inexpensive method, without reagents specific to each species, particularly compared to molecular biology methods, which gives a result in a short amount of time, less than one hour, and which can be used in routine clinical work, without requiring highly qualified personnel.

To this end, the invention proposes a new method of detecting, by mass spectrometry, at least one mechanism of resistance to at least one antimicrobial of at least one microorganism from a sample, characterised in that the antimicrobial is a carbapenem and in that proteins and/or peptides are detected as markers of said mechanism of resistance to at least one carbapenem-class antibiotic.

Preferably, the resistance markers are proteins from said at least one microorganism. Advantageously, markers of resistance to several different antimicrobials can be detected simultaneously.

As indicated in application PCT/FR2010/052181, markers of type and/or virulence of said microorganisms can be detected in the same way by mass spectrometry prior to or at the same time as the detection of the resistance mechanism markers.

Markers of resistance to at least one carbapenem-class antimicrobial is understood to mean molecules of protein origin which are characteristic of said properties.

Carbapenems are antibiotics belonging to the beta-lactam family and their main representatives are imipenem, meropenem, ertapenem and doripenem. These molecules are broken down by the beta-lactamases 2df, 2f and 3a of the classification by Bush and Jacoby ([9], Antimicrobial Agents and Chemotherapy, 2010; 54 (3): 969-976).

Determination of the resistance to at least one antimicrobial is understood to mean determining the susceptibility of a microorganism to being destroyed by an antimicrobial. The proteins involved in the resistance mechanisms will differ depending on the family and the species.

The nomenclature of the beta-lactamases, beta-lactam-resistant bacterial enzymes, is not standardised. They are either classified in four molecular classes (A to D) on the basis of their primary structure, or in functional groups on the basis of the target substrates and their resistance to inhibitors (for an overview, see [9] Bush and Jacoby, supra). For molecular classification, sequencing techniques have made more precise classification possible: for example, 183 variants of the TEM protein have been described (labelled TEM-i, with i being between 1 and 183). For the functional classification, Bush and Jacoby (supra) have proposed new functional subgroups:

- the group 1 enzymes are cephalosporinases belonging to the molecular class C. CMY and FOX are plasmid-borne enzymes, belonging to this subgroup.
- the group 2 enzymes belong to molecular classes A and D. This group is itself subdivided into subgroups, 2b, 2be, 2br, 2ber, 2d, 2de, 2df, 2f, etc. CTX-M (2be) and TEM (including 2be, 2br) are enzymes belonging to this subgroup. The subgroup 2b corresponds to broad-spectrum beta-lactamases which are inhibited by clavulanic acid, sulfobactam, or tazobactam. The subgroup 2be corresponds to extended-spectrum beta-lactamases (ESBL), which are also inhibited by clavulanic acid, sulfobactam or tazobactam. The subgroup 2br corresponds to beta-lactamases from the subgroup 2b which are insensitive to inhibition by clavulanic acid, sulfobactam or tazobactam. The subgroup 2df includes OXAs having a spectrum extended to carbapenems. Group 2f corresponds to carbapenemase beta-lactamases such as KPC.
- group 3 encompasses the metallo-beta-lactamases which hydrolyse carbapenems, such as IMP, VIM, SPM, GIM, SIM, AIM, KHM, DIM or NDM.

NDM-1 beta-lactamase was described in 2010 (Kumarasamy et al., 2010, Lancet Infect. Dis., 10:597-602). It corresponds to a metallo-beta-lactamase which confers a resistance to all beta-lactams except aztreonam.

KPC beta-lactamases were described from 2001 in the United States (Yigit et al., 2001, Antimicrobio. Agents Chemother., 45:1151-1161) and then throughout the world. They correspond to class-A beta-lactamases which confer a resistance to cephalosporins and to carbapenems, in particular to imipenem and to meropenem.

IMP beta-lactamases were described from 1994 in Japan (Osano et al., 1994, Antimicrobio. Agents Chemother., 38:71-78) and then throughout the world. They correspond to metallo-beta-lactamases which confer a resistance to cephalosporins and to carbapenems, but which do not confer resistance to Temocillin and to aztreonam.

VIM beta-lactamases were described from 1999 in Europe (Lauretti et al., 1999, Antimicrobio. Agents Chemother., 43:1584-1590) and then throughout the world. They correspond to metallo-beta-lactamases which confer a resistance to cephalosporins and to carbapenems, but which do not confer resistance to aztreonam.

The first GES beta-lactamase was isolated in 1998 in French Guiana (Poiret et al., 2000, Antimicrobio. Agents Chemother., 43:622-632). This enzyme (GES-1) conferred an ESBL resistance. The second isolate from a bacterium bearing a GES beta-lactamase was achieved in 2000 in South Africa (Poirel et al., 2001, Antimicrobio. Agents Chemother., 45:2598-2603). This enzyme (GES-2) conferred a resistance to cephalosporins and to carbapenems such as imipenem.

IND beta-lactamases were described for the first time in 1999 (Bellais et al., 1999, FEMS Microbio. Lett., 171:127-132). They correspond to metallo-beta-lactamases which confer a resistance to cephalosporins and to carbapenems.

SME beta-lactamases were described for the first time in 1994 (Naas et al., 1994, Antimicrobio. Agents Chemother., 38:1262-1270). They correspond to class-A beta-lactamases which confer a resistance to cephalosporins and to carbapenems.

OXA beta-lactamases (or oxacillinases) correspond to Class-D beta-lactamases. According to their primary sequence, they can confer resistances to cephalosporins or to cephalosporins and to carbapenems (Poirel et al., 2010, Antimicrobio. Agents Chemother., 54:24-38).

The method of the invention can be employed to detect mechanisms of resistance to carbapenems in bacteria. Thus, for example, as bacteria in which it is possible to seek a mechanism of resistance to carbapenems according to the method of the invention, non-exhaustive mention may be made of: *Escherichia coli, Klebsiella pneumoniae, Pseudomonas aeruginosa, Acinetobacter baumannii, Bacillus* spp, *Stenotrophomonas maltophilia, Aeromonas* spp, *Bacteroides fragilis, Pseudomonas otitidis* and *Enterobacter cloacae*, and more generally, the Enterobacteriaceae, which carry the $bla_{NDM-1}$ or $bla_{KPC}$ resistance gene. It should further be noted that the strains known to be resistant to carbapenems are also resistant to cephalosporins and to penicillins.

Thus, the method according to the invention also makes it possible to detect a mechanism of resistance to said antibiotics.

The sample on which the method of the invention can be employed is any sample susceptible of containing a target microorganism. The sample can be of biological origin, either animal, vegetable or human. In this case it may correspond to a specimen of biological fluid (whole blood, serum, plasma, urine, cerebrospinal fluid, organic secretion, for example), a tissue specimen or isolated cells. This specimen can be used such as it is, insofar as the markers of mechanisms of bacterial resistance to beta-lactams are available in the sample tested, or it can, prior to the analysis, undergo preparation by enrichment, extraction, concentration, purification, culturing, in accordance with methods known to the person skilled in the art.

The sample can be of industrial origin, or, according to a non-exhaustive list, can be an air specimen, a water specimen, a surface specimen, a part or a manufactured product, or a food product. Amongst the food samples, non-exhaustive mention can be made of a sample of a dairy product (yogurts, cheeses), of meat, of fish, of egg, of fruit, of vegetable, of water, of a beverage (milk, fruit juice, soda, etc.). These food samples can also come from sauces or ready meals. Finally, a food sample can come from an animal feed, such as animal meals.

Upstream of the detection by mass spectrometry, the sample to be analysed is preferably pretreated to produce peptides from the entirety of the proteins present in the sample to fragment these proteins into peptides, for example by digestion with a proteolytic enzyme (protease), or by the action of a chemical reagent. In fact, the cleaving of the protein can be performed by a physico-chemical treatment, by a biological treatment or by a combination of the two treatments. Amongst the useable treatments, mention can be made of treatment by hydroxyl radicals, in particular with $H_2O_2$. Treatment by hydroxyl radicals results in a cutting of the peptide bonds which takes place randomly on any of the protein's peptide bonds. The hydroxyl radical concentration determines the number of cleavages performed, and therefore the length of the peptide fragments obtained. Other chemical treatments can also be used such as, for example, cyanogen bromide (CNBr) treatment which specifically splits the peptide bonds at the carboxyl group of the methionyl residues. It is also possible to perform partial acid cleaving at the aspartyl residues by heating a solution of proteins in trifluoroacetic acid to 1000° C.

Treatment of the proteins by enzymatic digestion is nevertheless preferred over physico-chemical treatment because it preserves more of the structure of the protein, and is easier to control. "Enzymatic digestion" is understood to mean the single or combined action of one or more enzymes under appropriate reaction conditions. The enzymes carrying out the proteolysis, which are called proteases, cut the proteins at specific locations. Each protease generally recognises a sequence of amino acids within which it always makes the same cut. Certain proteases recognise a single amino acid or a sequence of two amino acids between which they perform a cleavage, whereas other proteases only recognise longer sequences. These proteases can be endoproteases or exoproteases. Amongst the known proteases, mention may be made of the following as described in WO2005/098071:

specific enzymes such as trypsin which splits the peptide bond at the carboxyl group of the Arg and Lys residues, endolysin which cleaves the peptide bond of the —CO group of the lysines, chymotrypsin which hydrolyses the peptide bond at the carboxylic group of the aromatic residues (Phe, Tyr and Trp), pepsin which makes a cut at the $NH_2$ group of the aromatic residues (Phe, Tyr and Trp), the protease V8 from the V8 strain of *Staphylococcus aureus* which cleaves the peptide bond at the carboxylic group of the Glu residue;

the non-specific enzymes such as thermolysin from the bacteria *Bacillus thermoproteolyticus* which hydrolyses the peptide bond of the $NH_2$ group of hydrophobic amino acids (Xaa-The, Xaa-Ile, Xaa-Phe), subtilisin and pronase which are bacterial proteases which hydrolyse practically all the bonds and can transform the proteins into oligopeptides under controlled reaction conditions (enzyme concentration and duration of reaction).

Several proteases may be used simultaneously, if their modes of action are compatible, or they may be used successively. Within the framework of the invention, the digestion of the sample is preferably performed by the action of a protease enzyme, for example trypsin.

The generation of peptides using a chemical reagent or a protease can be obtained by means of a simple reaction in solution. It can also be performed with a microwave oven [10], or under pressure [11], or even with an ultrasound device [12]. In these three latter cases, the protocol will be much faster.

Amongst the peptides thus obtained, the peptides specific to the protein are referred to as proteotypic peptides. It is these which will be assayed by mass spectrometry.

According to the invention, the markers of the mechanisms of bacterial resistance to carbapenems are proteins from the bacterium in which the mechanisms of resistance to cephalosporins are to be sought. In particular, said proteins are digested into peptides, preferably by an enzyme, and more preferably by trypsin.

Similarly, the sample containing protein markers characterising mechanisms of bacterial resistance to carbapenems can also be pretreated for the purposes of purification. This purification pretreatment can be employed before or after the peptide production step as described above.

The sample purification pretreatment is widely known to the person skilled in the art and may in particular employ the techniques of centrifugation, filtration, electrophoresis or chromatography. These separating techniques can be used alone or in combination with one another to obtain a multidimensional separation. For example, multidimensional chromatography can be used by combining separation by ion exchange chromatography with reversed-phase chromatography, as described by T. Fortin et al. [13], or H. Keshishian et al. [14]. In these publications, the chromatography medium can be in a column or in a cartridge (solid-phase extraction).

The electrophoretic or chromatographic fraction (or the retention time in monodimensional or multidimensional chromatography) of the proteotypic peptides is characteristic of each peptide, and employing these techniques therefore makes it possible to select the proteotypic peptide or peptides to be assayed. Such a fractionation of the produced peptides makes it possible to increase the specificity of the subsequent assay by mass spectrometry.

An alternative to the electrophoresis or chromatography techniques for the fractionation of the peptides consists in specifically purifying the N-glycopeptides ([15] and patent application WO 2008/066629). However, such a purification only makes it possible to quantify the peptides which have undergone an N-glycosylation post-translational modification. Not all proteins are glycosylated though, which therefore limits its use.

The mass spectrometry to be employed in the method of the invention is widely known to the person skilled in the art as a powerful tool for analysing and detecting different types of molecules. Generally, any type of molecule able to be ionised can be detected according to its molecular mass with the aid of a mass spectrometer. According to the nature of the molecule to be detected, whether of protein or metabolic origin, certain mass spectrometry technologies can be more suitable. Nevertheless, whatever mass spectrometry method is used for the detection, this latter includes a step of ionising the target molecule into so-called molecular ions, in the present case a step of ionising the characterising markers, and a step of separating the molecular ions obtained according to their mass.

All mass spectrometers therefore comprise:
  an ionising source intended to ionise the markers present in the sample to be analysed, i.e. to confer a positive or negative charge upon these markers;
  a mass analyser intended to separate the ionised markers, or molecular ions, according to their mass-to-charge ratio (m/z);
  a detector intended to measure the signal produced either directly by the molecular ions, or by ions produced from molecular ions as detailed hereafter.

The ionisation step necessary for employing mass spectrometry can be performed via any method known to the person skilled in the art. The ionising source makes it possible to transform the molecules to be assayed into a gaseous and ionised state. An ionising source can be used either in positive mode to study the positive ions, or in negative mode to study the negative ions. Several types of sources exist and will be used depending on the result sought and the molecules analysed. In particular, mention may be made of:
  electron ionisation (EI), chemical ionisation (CI) and desorption chemical ionisation (DCI)
  fast atom bombardment (FAB), metastable atom bombardment (MAB) or ion bombardment (SIMS, LSIMS) http://fr.wikipedia.org/wiki/Spectrom%C3%A9trie_de_masse_%C3%A0_ionisation_secondaire e
  inductively coupled plasma (ICP)http://fr.wikipedia.org/wiki/Torche_%C3%A0_plasma_(chimie)
  atmospheric-pressure chemical ionisation (APCI) and atmospheric-pressure photoionisation (APPI)http://fr.wikipedia.org/wiki/Ionisation_chimique_%C3%A0_pression_atmosph%C3%A9rique
  electronebulisation or electrospray (ESI)http://fr.wikipedia.org/wiki/Ionisation_par_%C3%A9lectron%C3%A9buliseur_(ESI)
  matrix-assisted laser desorption/ionisation (MALDI), surface-activated laser desorption/ionisation (SELDI) or desorption/ionisation on silicon (DIOS) http://fr.wikipedia.org/wiki/D%C3%A9sorption-ionisation_laser_assist%C3%A9e_par_matrice
  ionisation/desorption by interaction with metastable species (DART)

In particular, ionisation can be employed as follows: the sample containing the target molecules is introduced into an ionisation source, where the molecules are ionised in gaseous state and thus transformed into molecular ions which correspond to the initial molecules. An electrospray ionisation (ESI) source makes it possible to ionise a molecule by making it pass from a liquid state into a gaseous state. The molecular ions obtained therefore correspond to the molecules present in liquid state, with, in positive mode, one, two, or even three or more additional protons and therefore carry one, two, or even three or more charges. For example, when the target molecule is a protein, an ionisation of the proteotypic peptides obtained after fractionation of the target protein, by means of an electrospray source functioning in positive mode, leads to polypeptide ions in gaseous state, with one, two, or even three or more additional protons and which therefore carry one, two, or even three or more charges, and makes it possible to move from a liquid state to a gaseous state [16]. This type of source is particularly well suited when the target molecules or proteotypic peptides obtained are separated beforehand by reversed-phase liquid chromatography. Nevertheless, the ionisation yield of the molecules present in the sample may vary depending on the concentration and the nature of the different species present. This phenomenon leads to a matrix effect well known to the person skilled in the art.

A MALDI ionisation source will allow ionisation of the molecules from a solid-state sample.

The mass analyser in which the step of separating the ionised markers according to their mass-to-charge ratio (m/z) is performed is any mass analyser known to the person skilled in the art. Mention can be made of low-resolution analysers, quadripole or quadrupole (Q), 3D ion trap (IT) or linear ion trap (LIT), also called ion trap, and high-resolution analysers which make it possible to measure the exact mass of the analytes and which in particular use the magnetic sector linked to an electric sector, the time of flight (TOF), Fourier transform ion cyclotron resonance (FT-ICR), orbitrap.

The separation of the molecular ions depending upon their m/z ratio can be employed just once (single mass spectrometry or MS), or several successive MS separations can be conducted. When two successive MS separations are carried out, the analysis is called MS/MS or $MS^2$. When three successive MS separations are carried out, the analysis is called MS/MS/MS or $MS^3$, and more generally, when n successive MS separations are carried out, the analysis is called $MS^n$.

Amongst the techniques which employ several successive separations, SRM (Selected Reaction Monitoring) mode when detecting or assaying a single target molecule, or MRM (Multiple Reaction Monitoring) mode when detecting or assaying several target molecules are particular uses of $MS^2$ separation. Similarly the $MRM^3$ mode is a particular use of MS/MS/MS separation. This is referred to as targeted mass spectrometry.

In the case of a detection in single MS mode, it is the mass-to-charge ratio of the molecular ions obtained which is correlated to the target molecule to be detected.

In the case of detection in MS/MS mode, essentially two steps are added, compared to an MS assay, which are:
 a fragmentation of the molecular ions, then called precursor ions, to give ions called $1^{st}$ generation fragment ions, and
 a separation of the ions called $1^{st}$ generation fragment ions according to their mass $(m/z)_2$, the ratio $(m/z)_1$ corresponding to the ratio (m/z) of the precursor ions.

It is therefore the mass-to-charge ratio of the $1^{st}$ generation fragment ions thus obtained which is correlated to the target molecule to be detected. First-generation fragment ion is understood to be an ion derived from the precursor ion, following a fragmentation step and of which the mass-to-charge ratio m/z is different from the precursor ion.

The $(m/z)_1$ and $(m/z)_2$ pairs are called transitions and are representative of the characteristic ions to be detected.

The choice of the characteristic ions which are detected to be correlated to the target molecule is made by the person skilled in the art in accordance with the standard methods. Their selection will advantageously lead to the most sensitive, specific and robust assays possible, in terms of reproducibility and reliability. In the methods developed for the selection of proteotypic peptides $(m/z)_1$, and of the first-generation fragment $(m/z)_2$, the choice is essentially based on the intensity of the response. For more details, it is possible to refer to V. Fusaro et al. [17]. Commercially available software, such as the MIDAS and MRM Pilot software from Applied Biosystems or MRMaid [18] can be used by the person skilled in the art to allow him to predict all the possible transition pairs. He can also make use of a database called PeptideAtlas constructed by F Desiere et al. [19] to compile all of the MRM transitions of peptides described by the scientific community. This database PeptideAtlas is freely available on the Internet. For non-protein molecules, it is also possible to use databases, such as, for example, the one accessible through the Cliquid software from the company Applied Biosystems (United States of America).

An alternative approach to selecting the proteotypic peptides $(m/z)_1$ and $(m/z)_2$ consists in using MS/MS fragmentation spectra obtained during other work. This work can be, for example, the phases of biomarker discovery and identification by proteomic analysis. This approach was proposed by Thermo Scientific during user conferences [18]. It makes it possible to generate a list of candidate transitions from the peptides identified through testing by the SIEVE (Thermo Scientific) software. Certain criteria were detailed by J. Mead et al. [18] for the choice of the ions $(m/z)_1$ and $(m/z)_2$ and are detailed hereafter:
 peptides with internal cleavage sites, i.e. with internal Lysine or Arginine, must be avoided, unless the Lysine or Arginine is followed by Proline,
 peptides with Aspargine or Glutamine must be avoided because they may deaminate,
 peptides with Glutamine or Glutamic Acid at the N-terminal must be avoided because they may cyclise spontaneously,
 peptides with Methionine must be avoided because they may be oxidised,
 peptides with Cysteine must be avoided because they may be non-reproducibly modified during a potential step of denaturation, reduction and blocking of the thiol functions,
 peptides with Proline may be considered to be favourable because they generally produce intense fragments in MS/MS with a very strong single peak. However, a very strong single fragment does not make it possible to validate the identity of the transition in a complex mixture. Indeed, only the simultaneous presence of several characteristic fragments makes it possible to verify that the precursor ion sought has actually been detected,
 the peptides having a Proline adjacent to the C-terminal (Position n-1) or in second position relative to the C-terminal (position n-2) should be avoided because, in this case, the size of the first-generation peptide fragment is generally considered to be too small to be sufficiently specific,
 the selection of fragments having a mass greater than the precursor should be given preference in order to promote specificity. To this end, it is necessary to select a dicharged precursor ion and select the most intense first-generation ion fragment having a mass greater than the precursor, i.e. a monocharged first-generation fragment ion.

The fragmentation of the selected precursor ions is performed in a fragmentation cell such as the triple quadripole model [20], ion trap model [21], or time-of-flight (TOF) model [22], which also make it possible to separate ions. The fragmentation or fragmentations will be conventionally performed by collision with an inert gas such as argon or nitrogen, within an electrical field, by photo-excitation or photo-dissociation using an intense light source, collision with electrons or radical species, by applying a potential difference, for example in a time-of-flight tube, or by any other activation mode. The characteristics of the electrical field determine the intensity and nature of the fragmentation. Thus, the electrical field applied in the presence of an inert gas, for example in a quadripole, determines the collision energy provided to the ions. This collision energy will be optimised, by the person skilled in the art, to increase the sensitivity of the transition to be assayed. By way of example, it is possible to vary the collision energy between 5 and 180 e⁻V in q2 in an AB SCIEX QTRAP® 5500 mass spectrometer from the company Applied Biosystems (Foster City, United States of America). Similarly, the duration of the collision step and the excitation energy within, for example, an ion trap will be optimised by the person skilled in the art to lead to the most sensitive assay. By way of example, it is possible to vary this duration, called excitation time, between 0.010 et 50 ms and the excitation energy between 0 and 1 (arbitrary unit) in Q3 in an AB SCIEX QTRAP® 5500 mass spectrometer by the company Applied Biosystems.

Finally, the detection of the selected characteristic ions takes place in the conventional manner, particularly by means of a detector and a processing system. The detector collects the ions and produces an electrical signal whose intensity depends on the amount of ions collected. The signal obtained is then amplified such that it can be processed by computer. A computer data processing assembly makes it possible to transform the information received by the mass spectrum detector.

The principle of the SRM mode, or even of the MRM mode, is to specifically select a precursor ion, fragment it, and then specifically select one of its fragment ions. For such applications, triple quadripole or hybrid triple quadripole/ion trap devices are generally used.

In the case of a triple quadripole device (Q1q2Q3) used in $MS^2$ mode, with a view to assaying or detecting a target protein, the first quadripole (Q1) makes it possible to filter the molecular ions corresponding to the proteotypic peptides characteristic of the protein to be assayed and obtained during an earlier digestion step, depending on their mass-to-charge ratio (m/z). Only the peptides having the mass-to-charge ratio of the proteotypic peptide sought, which ratio is called $(m/z)_1$, are transmitted into the second quadripole (q2) and act as precursor ions for the subsequent fragmentation. The analyser q2 can fragment the peptides of mass-to-charge ratio $(m/z)_1$ into first-generation fragment ions. Fragmentation is generally obtained through collision of the precursor peptides with an inert gas, such as nitrogen or argon in q2. The first-generation fragment ions are transmitted into a third quadripole (Q3) which filters the first-generation fragment ions depending on a specific mass-to-charge ratio, called $(m/z)_2$. Only the first-generation fragment ions having the mass-to-charge ratio of a fragment characteristic of the sought proteotypic peptide $(m/z)_2$ are transmitted into the detector in order to be detected, or even quantified.

This mode of operation exhibits a double selectivity, with regard to the selection of the precursor ion on the one hand, and the selection of the first-generation fragment ion on the other hand. Mass spectrometry in SRM or MRM mode is therefore advantageous for quantification.

When the mass spectrometry employed in the method according to invention is tandem mass spectrometry ($MS^2$, $MS^3$, $MS^4$ or $MS^5$), several mass analysers can be linked to one another. For example, a first analyser separates the ions, a collision cell makes it possible to fragment the ions, and a second analyser separates the fragment ions. Certain analysers, such as the ion traps or the FT-ICR, constitute several analysers in one and make it possible to fragment the ions and analyse the fragments directly.

According to preferred embodiments of the invention, the method of the invention comprises one or more of the following characteristics:

the mass spectrometry employed for the properties of potential resistance to at least one antimicrobial is MS/MS spectrometry, which has the advantage of producing a fragment which is specific to the molecule to be detected or quantified, and thus of providing great specificity to the assaying method;

the MS/MS spectrometry is MRM which has the advantage of using an analysis cycle time in the mass spectrometer of several tens of milliseconds, which makes it possible to detect or quantify, with a high degree of sensitivity, a large number of different molecules in a multiplexed manner;

where applicable, the determination of the type properties and of the virulence factor is performed in the same mass spectrometry apparatus as the determination of the markers of resistance to at least one antimicrobial, preferably simultaneously, which has the advantage of reducing the analysis time and the cost of the instrument, which also facilitates the processing and the yielding of the results.

In addition to determining the resistance to an antibiotic, it is necessary to identify the microorganism or microorganisms present in the sample to be tested.

The methods of identifying microorganisms are widely known to the person skilled in the art, as described for example by Murray P. R. et al. in Manual of Clinical Microbiology, 2007, $9^{th}$ edition, and especially in Vol. I, Section III, chapters 15 and 16 for bacteria and yeasts, Vol. II, Section VI, chapter 82 for viruses, and Vol. II, Section X, chapter 135 for protozoa. As an example of conventional identification methods, mention can be made of the determination of the biological profile, by using the Vitek 2 (bioMérieux) identification cards, for example, or even by using molecular biology techniques with identification criteria based on the study of the presence of certain genes, and on the study of their sequence.

Identification can be performed directly from the sample in which the identification is made, or the microorganisms contained in the sample can be cultured using methods well known to the person skilled in the art with optimal culture media and culturing conditions tailored to the species of microorganisms to be sought, as described by Murray P. R. et al. in Manual of Clinical Microbiology, 2007, $9^{th}$ edition, Vol. I, Section III, chapter 14, and in particular in Vol. I, Section IV, chapter 21 for bacteria, and Vol. II, Section VI, chapter 81 for viruses, Vol. II, Section VIII, chapter 117 for yeasts, and Vol. II, Section X, chapter 134 for protozoa.

Thus, generally, in the case of an identification using a biochemical method of a bacterium in a specimen, it is first necessary to obtain it in a pure culture, for example after seeding on agar. Molecular biology (PCR) can in certain cases be applied directly to the sample to be analysed.

Instead of cultivating the microorganisms, they can be concentrated by capture directly in the sample by means of active surfaces. Such a method was described by W.-J. Chen et al. [10] who captured different bacterial species with the aid of magnetic beads with an $Fe_3O_4/TiO_2$-activated surface. Capture by other means is also possible, such as a capture by lectins [23], or by antibodies [24], or by Vancomycin [25]. The capture makes it possible to concentrate the microorganisms and thus to reduce or even eliminate the culture step. This results in a considerable time saving.

The identification may also be performed by mass spectrometry, in accordance with the techniques described previously, preferably by MS, by MS/MS, or even by MS followed by MS/MS spectrometry, which constitutes one embodiment of the invention. In this case too, the sample can be subjected to a culture step beforehand, such as seeding on agar.

The use of an MS identification method is advantageous in that it may be carried out in a few minutes, and in that it requires a mass spectrometer with a single analyser, i.e. a less complex instrument than a tandem mass spectrometer used in MS/MS.

The use of a method of identification by MS followed by MS/MS spectrometry is also advantageous. It makes it possible to check the identity of the ions observed by MS, which increases the specificity of the analysis.

The use of an MRM-type MS/MS identification method has the advantage of being more sensitive and simpler than the conventional MS followed by MS/MS approaches. This method requires neither a high-performance software to process the information between the acquisition of the MS spectrum and of the MS/MS spectrum, nor a change in the setting of the machine parameters for linking up MS then MS/MS spectra.

The method of identification by MS may be employed with an electrospray source on a raw sample, as described by S. Vaidyanathan et al. [26] or by R. Everley et al. [27] after chromatographic separation. Different m/z ranges thus make it possible to identify the microorganisms. S. Vaidyanathan et al. used a window of between 200 and 2000 Th, and R. Everley et al. used a window of between 620 and 2450 Th. The mass spectra may also be deconvoluted to access the mass of the proteins independently of their charge state. R. Everley et al. therefore used masses of between about 5,000 and 50,000 Da. Alternatively, the method of identification by MS can also be employed with the aid of a MALDI-TOF, as described by Claydon et al. [3] and T. Krishnamurthy and P. Ross [4]. The analysis combines acquisition of a mass spectrum and interpretation of expert software. It is extremely simple and can be carried out in a few minutes. This method of identification is currently becoming more widespread in medical analysis laboratories [28].

The identification of bacteria by MS followed by MS/MS via their proteins present in the sample has been applied widely by a number of teams. By way of example, mention can be made of the recent work of Manes N. et al. [29], who studied the peptidome of *Salmonella enterica*, or the work of R. Nandakumar et al. [30] or of L. Hernychova et al. [31] who have studied the proteome of bacteria after digestion of the proteins with trypsin. The conventional approach consists in i) acquiring an MS spectrum, ii) successively selecting each precursor ion observed on the MS spectrum with an intense signal, iii) successively fragmenting each precursor ion and acquiring its MS/MS spectrum, iv) interrogating protein databases such as SWISS-PROT or NCBI, through software such as Mascot (Matrix Science, London, United Kingdom) or SEQUEST (Thermo Scientific, Waltham, United States of America), to identify the peptide which has a strong probability of matching the MS/MS spectrum observed. This method may lead to the identification of a microorganism if a protein or a peptide characteristic of the species is identified.

One of the advantages of the use of mass spectrometry lies in that it is particularly useful for quantifying molecules, in the present case the markers of the mechanisms of bacterial resistance to beta-lactams. To this end, the current intensity detected is used, which is proportional to the quantity of target molecule. The current intensity thus measured may serve as a quantitative measurement making it possible to determine the quantity of target molecule present, which is characterised by its expression in International System (SI) mol/m$^3$ or kg/m$^3$ units, or by multiples or sub-multiples of these units, or by the usual derivatives of the SI units, including multiples or sub-multiples thereof. As a non-limiting example, the units such as ng/ml or fmol/l are units characterising a quantitative measurement.

A calibration is nevertheless necessary in order to be able to correlate the measured area of the peak, which corresponds to the current intensity induced by the detected ions, to the quantity of target molecule to be assayed. For this purpose, the calibrations conventionally used in mass spectrometry may be employed, within the framework of the invention. MRM assays are conventionally calibrated with the aid of external standards or, preferably, with the aid of internal standards such as described by T. Fortin et al. [13]. If the target molecule is a proteotypic peptide which permits the assaying of a protein of interest, the correlation between the quantitative measurement and the quantity of target proteotypic peptide, and subsequently of protein of interest, is obtained by calibrating the measured signal relative to a standard signal for which the quantity to be assayed is known. The calibration may be performed using a calibration curve, for example obtained by successive injections of standard proteotypic peptide at different concentrations (external calibration), or preferably by internal calibration using a heavy peptide as an internal standard, for example in accordance with the AQUA, QconCAT or PSAQ methods detailed below. "Heavy peptide" is understood to mean a peptide corresponding to the proteotypic peptide, but in which one or more atoms of carbon 12 ($^{12}$C) is (are) replaced by carbon 13 ($^{13}$C), and/or one or more atoms of nitrogen 14 ($^{14}$N) is (are) replaced by nitrogen 15 ($^{15}$N).

The use of heavy peptides as internal standards (AQUA) was also proposed in US patent application 2004/0229283. The principle is to artificially synthesise proteotypic peptides with amino acids containing isotopes which are heavier than the usual natural isotopes. Such amino acids are obtained, for example, by replacing some of the atoms of carbon 12 ($^{12}$C) with carbon 13 ($^{13}$C), or by replacing some of the atoms of nitrogen 14 ($^{14}$N) with nitrogen 15 ($^{15}$N). The artificial peptide (AQUA) thus synthesised has strictly the same physicochemical properties as the natural peptide (with the exception of a higher mass). It is generally added, at a given concentration, to the sample, upstream of assaying by mass spectroscopy, for example between the treatment entailing the cleaving of the proteins in the sample of interest and the fractionation of the peptides obtained after the treatment step. Thus, the AQUA peptide is co-purified with the natural peptide to be assayed, during fractionation of the peptides. The two peptides are therefore injected simultaneously into the mass spectrometer, for assaying. They then undergo the same ionisation yield in the source. The comparison of the peak areas of the natural and AQUA peptides, whose concentration is known, makes it possible to calculate the concentration of the natural peptide and thus the concentration of the protein to be assayed. A variation of the AQUA technique was proposed by J.-M. Pratt et al. [32] under the name QconCat. This variant is also described in patent application WO 2006/128492. It consists in concatenating various AQUA peptides and producing the artificial polypeptide in the form of a heavy recombinant protein. The recombinant protein is synthesised with amino acids comprising heavy isotopes. In this way, it is possible to obtain a standard to calibrate the simultaneous assay of several proteins at lower cost. The QconCAT standard is added from the start, upstream of the treatment entailing the cleaving of the proteins and prior to the steps of protein fractionation, denaturation, reduction and blocking of the protein thiol functions, if these are present. The QconCAT standard therefore undergoes the same treatment cycle entailing the cleaving of the proteins as the natural protein, which makes it possible to take account of the yield from the treatment step which entails the cleaving of the proteins. In fact, the treatment, particularly by digestion, of the natural protein may not be complete. In this case, the use of an AQUA standard would lead to underestimating the quantity of natural protein. For full assaying, it may therefore be important to take into account the yields from treatment which entails the cleaving of the proteins. However, V. Brun et al. [33] have shown that the QconCAT standards sometimes do not exactly reproduce the treatment yield particularly by digestion of the natural protein, undoubtedly due to a three-dimensional conformation different from the Qcon-CAT protein.

V. Brun et al. [33] then proposed the use of a method dubbed PSAQ, and described in patent application WO 2008/145763. In this case, the internal standard is a recombinant protein having the same sequence as the natural protein but synthesised with heavy amino acids. The synthesis is performed ex-vivo with heavy amino acids. This standard has strictly the same physicochemical properties as the natural protein (with the exception of a higher mass). It is added from the start, before the protein fractionation step, when the latter is present. It is therefore co-purified with the native protein, during the protein fractionation step. It exhibits the same treatment yield, particularly by digestion, as the native protein. The heavy peptide obtained after cleaving is also co-purified with the natural peptide, if a peptide fractionation step is performed. The two peptides are therefore injected simultaneously into the mass spectrometer, to be quantitatively assayed. They then undergo the same ionisation yields in the source. Comparison of the peak areas of the natural and the reference peptides in the PSAQ method makes it possible to calculate the concentration of the protein to be assayed taking into account all of the steps of the assay method.

All of these techniques, namely AQUA, QconCAT or PSAQ or any other calibration technique, used in the mass spectrometry assays and in particular in MRM or MS assays, may be employed to carry out calibration, within the framework of the invention.

Preferably, the mass spectrometry used in the detection method according to the invention is MS/MS. More preferably, the mass spectrometry is MRM.

The method of the invention makes it possible to detect resistances to carbapenems, characterised by the detection of at least one peptide as a resistance marker. Said resistance marker peptide preferably belongs to the proteins NDM, KPC, GES, IMP, IND, SME, VIM or OXA.

In particular, the detection of a mechanism of resistance to carbapenems induced by the expression of an NDM protein is characterised by the detection of at least one peptide belonging to an NDM protein and its different sequence variants SEQ ID No. 1 and SEQ ID No. 1078 to SEQ ID No. 1080.

SEQ ID No. 1:
MELPNIMHPVAKLSTALAAALMLSGCMPGEIRPTIGQQMETGDQRFGDL

VFRQLAPNVWQHTSYLDMPGFGAVASNGLIVRDGGRVLVVDTAWTDDQT

-continued

AQILNWIKQEINLPVALAVVTHAHQDKMGGMDALHAAGIATYANALSNQ

LAPQEGMVAAQHSLTFAANGWVEPATAPNFGPLKVFYPGPGHTSDNITV

GIDGTDIAFGGCLIKDSKAKSLGNLGDADTEHYAASARAFGAAFPKASM

IVMSHSAPDSRAAITHTARMADKLR

SEQ ID No. 1078
MELPNIMHPVAKLSTALAAALMLSGCMAGEIRPTIGQQMETGDQRFGDL

VFRQLAPNVWQHTSYLDMPGFGAVASNGLIVRDGGRVLVVDTAWTDDQT

AQILNWIKQEINLPVALAWTHAHQDKMGGMDALHAAGIATYANALSNQL

APQEGMVAAQHSLTFAANGWVEPATAPNFGPLKVFYPGPGHTSDNITVG

IDGTDIAFGGCLIKDSKAKSLGNLGDADTEHYAASARAFGAAFPKASMI

VMSHSAPDSRAAITHTARMADKLR

SEQ ID No. 1079
MELPNIMHPVAKLSTALAAALMLSGCMPGEIRPTIGQQMETGDQRFGDL

VFRQLAPNVWQHTSYLDMPGFGAVASNGLIVRDGGRVLVVDTAWTDDQT

AQILNWIKQEINLPVALAVVTHAHQDKMGGMDALHAAGIATYANALSNQ

LAPQEGLVAAQHSLTFAANGWVEPATAPNFGPLKVFYPGPGHTSDNITV

GIDGTDIAFGGCLIKDSKAKSLGNLGDADTEHYAASARAFGAAFPKASM

IVMSHSAPDSRAAITHTARMADKLR

SEQ ID No. 1080
MELPNIMHPVAKLSTALAAALMLSGCMPGEIRPTIGQQMETGDQRFGDL

VFRQLAPNVWQHTSYLDMPGFGAVASNGLIVRDGGRVLVVDTAWTDDQT

AQILNWIKQEINLPVALAVVTHAHQDKMGGMDALHAAGIATYANALSNQ

LAPQEGMVAAQHSLTFAANGWVEPATAPNFGPLKVFYPGPGHTSDNITV

GIDGTDIAFGGCLIKDSKAKSLGNLGDADTEHYAASARAFGAAFPKASM

IVMSHSAPDSRAAITHTARMADKLR said peptides being chosen, preferably, from the peptides of sequence SEQ ID No. 2 to SEQ ID No. 9 and SEQ ID No. 1083 as defined hereafter:

| Peptide SEQ ID No. | Amino acid sequence | Position of the peptide in the NDM protein(s) |
|---|---|---|
| SEQ ID No. 2 | AAITHTAR | 257-264 for the proteins of SEQ No. 1, 1078, 1079, 1080 |
| SEQ ID No. 3 | AFGAAFPK | 235-242 for the proteins of SEQ No. 1, 1078, 1079, 1080 |
| SEQ ID No. 4 | ASMIVMSH SAPDSR | 243-256 for the proteins of SEQ No. 1, 1078, 1079, 1080 |
| SEQ ID No. 5 | FGDLVFR | 46-52 for the proteins of SEQ No. 1, 1078, 1079, 1080 |
| SEQ ID No. 6 | MELPNIM HPVAK | 1-12 for the proteins of SEQ No. 1, 1078, 1079, 1080 |
| SEQ ID No. 7 | QEINLPV ALAVVTH AHQDK | 107-125 for the proteins of SEQ No. 1, 1078, 1079, 1080 |

| Peptide SEQ ID No. | Amino acid sequence | Position of the peptide in the NDM protein(s) |
|---|---|---|
| SEQ ID No. 8 | SLGNLGD ADTEHYA ASAR | 217-234 for the proteins of SEQ No. 1, 1078, 1079, 1080 |
| SEQ ID No. 9 | VLVVDTA WTDDQTA QILNWIK | 86-106 for the proteins of SEQ No. 1, 1078, 1080 |
| SEQ ID No. 1081 | LSTALAA ALMLSGC MAGEIR | 13-32 for the protein of SEQ No. 1078 |
| SEQ ID No. 1082 | LSTALAA ALMLSGC MPGEIR | 13-32 for the protein of SEQ No. 1, 1079, 1080 |
| SEQ ID No. 1083 | VLLVDTA WTDDQTA QILNWIK | 86-106 for the protein of SEQ No. 1079 |

Preferably, the resistance markers are NDM markers, chosen from the peptides of sequence SEQ ID No. 2, SEQ ID No. 3, SEQ ID No. 5, or SEQ ID No. 7.

The detection of a mechanism of resistance to carbapenems induced by the expression of a KPC protein is characterised by the detection of at least one peptide belonging to a KPC protein and to its different sequence variants SEQ ID No. 10 to SEQ ID No. 19 and SEQ ID No. 1084 to SEQ ID No. 1093.

SEQ ID No. 10:
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVPWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGVYGTAND

YAVVWPTGRAPIVLAVYTRAPNKDDKHSEAVIAAAARLALEGLGVNGQ

SEQ ID No. 11:
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVPWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGVYGTAND

YAVVWPTGRAPIVLAVYTRAPNKDDKYSEAVIAAAARLALEGLGVNGQ

SEQ ID No. 12:
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVRWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGVYGTAND

YAVVWPTGRAPIVLAVYTRAPNKDDKHSEAVIAAAARLALEGLGVNGQ

SEQ ID No. 13:
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVRWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGVYGTAND

YAVVWPTGRAPIVLAVYTRAPNKDDKHSEAVIAAAARLALEGLGVNGQ

SEQ ID No. 14:
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVPWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGGYGTAND

YAVVWPTGRAPIVLAVYTRAPNKDDKHSEAVIAAAARLALEGLGVNGQ

SEQ ID No. 15:
MSLYRRLVLLSCLSWPLAGFSATALTNLVAEPFAKLEQDFGGSIGVYAI

DTGSGATVSYRAEERFPLCSSFKGFLAAAVLARSQQQAGLLDTPIRYGK

NALVPWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGVYGTAND

YAVVWPTGRAPIVLAVYTRAPNKDDKYSEAVIAAAARLALEGLGVNGQ

SEQ ID No. 16:
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVPWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGGYGTAND

YAVVWPTGRAPIVLAVYTRAPNKDDKYSEAVIAAAARLALEGLGVNGQ

SEQ ID No. 17:
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVPWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGAYGTAND

YAVVWPTGRAPIVLAVYTRAPNKDDKYSEAVIAAAARLALEGLG

SEQ ID No. 18:
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVRWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGVYGTAND

YAVVWPTGRAPIVLAVYTRAPNKDDKYSEAVIAAAARLALEGLGVNGQ

SEQ ID No. 19:
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVLWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGVYGTAND

YAVVWPTGRAPIVLAVYTRAPNKDDKHSEAVIAAAARLALEGLGVNGQ

SEQ ID No. 1084
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVPWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGGYGTAND

YAVVWPTGRAPIVLAVYTRAPNKDDKHSEAVIAAAARLALEGLGVNGQ

SEQ ID No. 1085
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVPWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGGYGTAND

YAVVWPTGRAPIVLAVYTRAPNKDDKYSEAVIAAAARLALEGLGVNGQ

SEQ ID No. 1086
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVPWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGVYGTAND

YAVVWPTGRAPIVLAVYTRAPNKDDKHSEAVIAAAARLALEGLGVNGQ

SEQ ID No. 1087
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVPWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGVYGTAND

YAVVWPTGRAPIVLAVYTRAPNKDDKYSEAVIAAAARLALEGLGVNGQ

SEQ ID No. 1088
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVPWSPISEKYLTTGMTVAELSAAAVQYSDNAAANLLLKELGGPAGL

TAFMRSIGDTTFRLDRWELELNSAIPSDARDTSSPRAVTESLQKLTLGS

ALAAPQRQQFVDWLKGNTTGNHRIRAAVPADWAVGDKTGTCGVYGTAND

YAVVWPTGRAPIVLAVYTRAPNKDDKHSEAVIAAAARLALEGLGVNGQ

SEQ ID No. 1089
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVPWSPISEKYLTTGMTVAELSAAAVQYSDNAAANLLLKELGGPAGL

TAFMRSIGDTTFRLDRWELEMNSAIPGDARDTSSPRAVTESLQKLTLGS

ALAAPQRQQFVDWLKGNTTGNHRIRAAVPADWAVGDKTGTCGVYGTAND

YAVVWPTGRAPIVLAVYTRAPNKDDKHSEAVIAAAARLALEGLGVNGQ

SEQ ID No. 1090
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVRWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGVYGTAND

YAVVWPTGRAPIVLAVYTRAPNKDDKHSEAVIAAAARLALEGLGVNGQ

SEQ ID No. 1091
MSLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYGK

NALVRWSPISEKYLTTGMTVAELSAAAVQYSDNAAANLLLKELGGPAGL

TAFMRSIGDTTFRLDRWELELNSAIPGDARDTSSPRAVTESLQKLTLGS

ALAAPQRQQFVDWLKGNTTGNHRIRAAVPADWAVGDKTGTCGVYGTAND

YAVVWPTGRAPIVLAVYTRAPNKDDKYSEAVIAAAARLALEGLGVNGQ

SEQ ID No. 1092
RLVLLSCLSWPLAGFSATALTNLVAEPFAKLEQDFGGSIGVYAMDTGSG

ATVSYRAEERFPLCSSFKGFLAAAVLARSQQQAGLLDTPIRYGKNALVP

WSPISEKYLTTGMTVAELSAAAVQYSDNAAANLLLKELGGPAGLTAFMR

SIGDTTFRLDRWELELNSAIPGDARDTSSPRAVTESLQKLTLGSALAAP

QRQQFVDWLKGNTTGNHRIRAAVPADWAVGDKTGTCGAYGTANDYAVVW

PTGRAPIVLAVYTRAPNKDDKYSEAVIAAAARLALEGLG

SEQ ID No. 1093
SLYRRLVLLSCLSWPLAGFSATALTNLVAEPFAKLEQDFGGSIGVYAM

DTGSGATVSYRAEERFPLCSSFKGFLAAAVLARSQQQAGLLDTPIRYG

KNALVRWSPISEKYLTTGMTVAELSAAAVQYSDNAAANLLLKELGGPA

GLTAFMRSIGDTTFRLDRWELELNSAIPGDARDTSSPRAVTESLQKLT

LGSALAAPQRQQFVDWLKGNTTGNHRIRAAVPADWAVGDKTGTCGGYG

TANDYAVVWPTGRAPIVLAVYTRAPNKDDKHSEAVIAAAARLALEGLG

VNGQ said peptides being chosen, preferably, from the peptides of sequence SEQ ID No. 20 to SEQ ID No. 33 and SEQ ID No. 1094 to SEQ ID No. 1097 as defined hereafter:

| Peptide SEQ ID No. | Amino acid sequence | Position of the peptide in the KPC protein(s) |
|---|---|---|
| SEQ ID No. 20 | AAVPADWAVGDK | 221-232 for the protein of SEQ No. 1093; 222-233 for the proteins of sequence SEQ ID No. 10, 11, 12, 13, 14, 15, 16, 17, 18, 19, 1084, 1085, 1086, 1087, 1088, 1089, 1090, 1091, 1092 |
| SEQ ID No. 21 | APIVLAVYTR | 254-263 for the protein of SEQ No. 1093; 255-264 for the proteins of sequence SEQ ID No. 10, 11, 12, 13, 14, 15, 16, 17, 18, 19, 1084, 1085, 1086, 1087, 1088, 1089, 1090, 1091, 1092 |
| SEQ ID No. 22 | AVTESLQK | 183-190 for the protein of SEQ No. 1093; 184-191 for the proteins of sequence SEQ ID No. 10, 11, 12, 13, 14, 15, 16, 17, 18, 19, 1084, 1085, 1086, 1087, 1088, 1089, 1090, 1091, 1092 |
| SEQ ID No. 23 | ELGGPAGLTAFMR | 139-151 for the protein of SEQ No. 1093; 140-152 for the proteins of sequence SEQ ID No. 10, 11, 12, 13, 14, 15, 16, 17, 18, 19, 1084, 1085, 1086, 1087, 1088, 1089, 1090, 1091, 1092 |
| SEQ ID No. 24 | FPLCSSFK | 64-71 for the protein of SEQ No. 1093; 65-72 for the proteins of sequence SEQ ID No. 10, 11, 12, 13, 14, 15, 16, 17, 18, 19, 1084, 1085, 1086, 1087, 1088, 1089, 1090, 1091, 1092 |
| SEQ ID No. 25 | GFLAAAVLAR | 72-81 for the protein of SEQ No. 1093; 73-82 for the proteins of sequence SEQ ID No. 10, 11, 12, 13, 14, 15, 16, 17, 18, 19, 1084, 1085, 1086, 1087, 1088, 1089, 1090, 1091, 1092 |
| SEQ ID No. 26 | GNTTGNHR | 211-218 for the protein of SEQ No. 1093; 212-219 for the proteins of sequence SEQ ID No. 10, 11, 12, 13, 14, 15, 16, 17, 18, 19, 1084, 1085, 1086, 1087, 1088, 1089, 1090, 1091, 1092 |
| SEQ ID No. 27 | LALEGLGVNGQ | 282-292 for the protein of SEQ No. 1093; 283-293 for the proteins of sequence SEQ ID No. 10, 11, 12, 13, 14, 15, 16, 18, 19, 1084, 1085, 1086, 1087, 1088, 1089, 1090, 1091 |
| SEQ ID No. 28 | LTLGSALAAPQR | 191-202 for the protein of SEQ No. 1093; 192-203 for the proteins of sequence SEQ ID No. 10, 11, 12, 13, 14, 15, 16, 17, 18, 19, 1084, 1085, 1086, 1087, 1088, 1089, 1090, 1091, 1092 |
| SEQ ID No. 29 | NALVPWSPISEK | 94-105 for the protein of SEQ No. 1092; 99-110 for the proteins of sequence SEQ ID No. 10, 11, 14, 15, 16, 17, 1084, 1085, 1086, 1087, 1088, 1089 |
| SEQ ID No. 30 | QQFVDWLK | 203-210 for the protein of SEQ No. 1093; 204-211 for the proteins of sequence SEQ ID No. 10, 11, 12, 13, 14, 15, 16, 17, 18, 19, 1084, 1085, 1086, 1087, 1088, 1089, 1090, 1091, 1092 |
| SEQ ID No. 31 | SIGDTTFR | 152-159 for the protein of SEQ No. 1093; 153-160 for the proteins of sequence SEQ ID No. 10, 11, 12, 13, 14, 15, 16, 17, 18, 19, 1084, 1085, 1086, 1087, 1088, 1089, 1090, 1091, 1092 |
| SEQ ID No. 32 | SQQQAGLLDTPIR | 82-94 for the protein of SEQ No. 1093; 83-95 for the proteins of sequence SEQ ID No. 10, 11, 12, 13, 14, 15, 16, 17, 18, 19, 1084, 1085, 1086, 1087, 1088, 1089, 1090, 1091, 1092 |
| SEQ ID No. 33 | WELELNSAIPGDAR | 163-176 for the protein of SEQ No. 1093; 164-177 for the proteins of sequence SEQ ID No. 10, 11, 12, 13, 14, 15, 16, 17, 18, 19, 1084, 1085, 1086, 1087, 1090, 1091, 1092 |
| SEQ ID No. 1094 | NALVR | 98-102 for the proteins of SEQ No. 1093; 99-103 for the proteins of sequence SEQ ID No. 12, 13, 18, 1090, 1091 |
| SEQ ID No. 1095 | TGTCGAYGTANDYAVVWPTGR | 229-249 for the protein of SEQ No. 1092; 234-254 for the protein of sequence SEQ ID No. 17 |

| Peptide SEQ ID No. | Amino acid sequence | Position of the peptide in the KPC protein(s) |
|---|---|---|
| SEQ ID No. 1096 | WELELNSAIPSDAR | 164-177 for the protein of SEQ No. 1088 |
| SEQ ID No. 1097 | WELEMNSAIPGDAR | 164-177 for the protein of SEQ No. 1089 |

Preferably, the resistance markers are KPC markers, chosen from the peptides of sequence SEQ ID No. 20, SEQ ID No. 21, SEQ ID No. 23, SEQ ID No. 25, SEQ ID No. 28, SEQ ID No. 29, SEQ ID No. 31, or SEQ ID No. 32.

The detection of a mechanism of resistance to carbapenems and/or to cephalosporins induced by the expression of a GES protein is characterised by the detection of at least one peptide belonging to a GES protein and to its different sequence variants SEQ ID No. 34 to SEQ ID No. 50.

SEQ ID No. 34:
MRFIHALLLAGIAHSAYASEKLTFKTDLEKLEREKAAQIGVAIVDPQGE

IVAGHRMAQRFAMCSTFKFPLAALVFERIDSGTERGDRKLSYGPDMIVE

WSPATERFLASGHMTVLEAAQAAVQLSDNGATNLLLREIGGPAAMTQYF

RKIGDSVSRLDRKEPEMGDNTPGDLRDTTTPIAMARTVAKVLYGGALTS

TSTHTIERWLIGNQTGDATLRAGFPKDWVVGEKTGTCANGGRNDIGFFK

AQERDYAVAVYTTAPKLSAVERDELVASVGQVITQLILSTDK

SEQ ID No. 35:
MRFIHALLLAGIAHSAYASEKLTFKTDLEKLEREKAAQIGVAIVDPQGE

IVAGHRMAQRFAMCSTFKFPLAALVFERIDSGTERGDRKLSYGPDMIVK

WSPATERFLASGHMTVLEAAQAAVQLSDNGATNLLLREIGGPAAMTQYF

RKIGDSVSRLDRKEPEMGDNTPGDLRDTTTPIAMARTVAKVLYGGALTS

TSTHTIERWLIGNQTGDATLRAGFPKDWVVGEKTGTCANGGRNDIGFFK

AQERDYAVAVYTTAPKLSAVERDELVASVGQVITQLILSTDK

SEQ ID No. 36:
MRFIHALLLAGIAHSAYASEKLTFKTDLEKLEREKAAQIGVAIVDPQGE

IVAGHRMAQRFAMCSTFKFPLAALVFERIDSGTERGDRKLSYGPDMIVE

WSPATERFLASGHMTVLEAAQLAVQLSDNGATNLLLREIGGPAAMTQYF

RKIGDSVSRLDRKEPEMGDNTPGDLRDTTTPIAMARTVAKVLYGGALTS

TSTHTIERWLIGNQTGDATLRAGFPKDWVVGEKTGTCANGGRNDIGFFK

AQERDYAVAVYTTAPKLSAVERDELVASVGQVITQLILSTDK

SEQ ID No. 37:
MRFIHALLLAGIAHSAYASEKLTFKTDLEKLEREKAAQIGVAIVDPQGE

IVAGHRMAQRFAMCSTFKFPLAALVFERIDSGTERGDRKLSYGPDMIVE

WSPATERFLASGHMTVLEAAQAAVQLSDNGATNLLLREIGGPAAMTQYF

RKIGDSVSRLDRKEPEMNDNTPGDLRDTTTPIAMARTVAKVLYGGALTS

TSTHTIERWLIGNQTGDATLRAGFPKDWVVGEKTGTCANGGRNDIGFFK

AQERDYAVAVYTTAPKLSAVERDELVASVGQVITQLILSTDK

SEQ ID No. 38:
MRFIHALLLAGIAHSAYASEKLTFKTDLEKLEREKAAQIGVAIVDPQGE

IVAGHRMAQRFAMCSTFKFPLAALVFERIDSGTERGDRKLSYGPDMIVE

WSPATERFLASGHMTVLEAAQAAVQLSDNGATNLLLREIGGPAAMTQYF

RKIGDSVSRLDRKEPEMSDNTPGDLRDTTTPIAMARTVAKVLYGGALTS

TSTHTIERWLIGNQTGDATLRAGFPKDWVVGEKTGTCANGGRNDIGFFK

AQERDYAVAVYTTAPKLSAVERDELVASVGQVITQLILSTDK

SEQ ID No. 39:
MRFIHALLLAGIAHSAYASEKLTFKTDLEKLEREKAAQIGVAIVDPQGE

IVAGHRMAQRFAMCSTFKFPLAALVFERIDSGTERGDRKLSYGPDMIVK

WSPATERFLASGHMTVLEAAQAAVQLSDNGATNLLLREIGGPAAMTQYF

RKIGDSVSRLDRKEPEMSDNTPGDLRDTTTPIAMARTVAKVLYGGALTS

TSTHTIERWLIGNQTGDATLRAGFPKDWVVGEKTGTCANGGRNDIGFFK

AQERDYAVAVYTTAPKLSAVERDELVASVGQVITQLILSTDK

SEQ ID No. 40:
MRFIHALLLAGIAHSAYASEKLTFKTDLEKLEREKAAQIGVAIVDPQGE

IVAGHRMAQRFAMCSTFKFPLAALVFERIDSGTERGDRKLSYGPDMIVE

WSPATERFLASGHMTVLEAAQAAVQLSDNGATNLLLREIGGPAAMTQYF

RKIGDSVSRLDRKEPEMGDNTPGDLRDTTTPIAMARTVAKVLYGGALTS

TSTHTIERWLIGNQTGDATLRAGFPKDWVVGEKTGTCANGSRNDIGFFK

AQERDYAVAVYTTAPKLSAVERDELVASVGQVITQLILSTDK

SEQ ID No. 41:
MRFIHALLLAGIAHSAYASEKLTFKTDLEKLEREKAAQIGVAIVDPQGE

IVAGHRMAQRFAMCSTFKFPLAALVFERIDSGTERGDRKLSYGPDMIVE

WSPATERFLASGHMTVLEAAQAAVQLSDNGATNLLLREIGGPAAMTQYF

RKIGDSVSRLDRKEPEMGDNTPGDLRDTTTPIAMARTVAKVLYGGALTS

TSTHTIERWLIGNQTGDATLRAGFPKDWVVGEKTGTCANGARNDIGFFK

AQERDYAVAVYTTAPKLSAVERDELVASVGQVITQLILSTDK

SEQ ID No. 42:
MRFIHALLLAGTAHSAYASEKLTFKTDLEKLEREKAAQIGVAIVDPQGE

IVAGHRTAQRFAMCSTFKFPLAALVFERIDSGTERGDRKLSYGPDMIVE

WSPATERFLASGHMTVLEAAQAAVQLCDNGATNLLLREIGGPAAMTQYF

RKIGDSVSRLDRKEPEMGDNTPGDLRDTTTPIAMARTVAKVLYGGALTS

TSTHTIERWLIGNQTGDATLRAGFPKDWVVGEKTGTCANGGRNDIGFFK

AQERDYAVAVYTTAPKLSAVERDELVASVGQVITQLILSTDK

SEQ ID No. 43:
MRFIHALLLAGIAHSAYASEKLTFKTDLEKLEREKAAQIGVAIVDPQGE

IVAGHRMAQRFAMCSTFKFPLAALVFERIDSGTERGDRKLSYGPDMIVK

WSPATERFLASGHMTVLEAAQAAVQLSDNGATNLLLREIGGPAAMTQYF

RKIGDSVSRLDRKEPEMNDNTPGDLRDTTTPIAMARTVAKVLYGGALTS

TSTHTIERWLIGNQTGDATLRAGFPKDWVVGEKTGTCANGGRNDIGFFK

AQERDYAVAVYTTAPKLSAVERDELVASVGQVITQLILSTDK

SEQ ID No. 44:
MRFIHALLLAGIAHSAYASEKLTFKTDLEKLEREKAAQIGVAIVDPQGE

IVAGHRMAQRFAMCSTFKFPLAALVFERIDSGTERGDRKLSYGPDMIVE

WSPATERFLASGHMTVLEAAQAAVQLSDNGATNLLLREIGGPAAMTQYF

RKIGDSVSRLDRKESEMSDNTPGDLRDTTTPIAMARTVAKVLYGGALTS

TSTHTIERWLIGNQTGDATLRAGFPKDWVVGEKTGTCANGGRNDIGFFK

AQERDYAVAVYTTAPKLSAVERDELVASVGQVITQLILSTDK

SEQ ID No. 45:
MRFIHALLLAGIAHSAYASEKLTFKTDLEKLEREKAAQIGVAIVDPQGE

IVAGHRMAQRFAMCSTFKFPLAALVFERIDSGTERGDRKLSYGPDMIVE

WSPATERFLASGHMTVLEAAQAAVQLSDNGATNLLLREIGGPAAMTQYF

RKIGDSVSRLDRKEPEMSDNTPGDLRDTTTPIAMARTVAKVLYGGALTS

TSTHTIERWLIGNQTGDATLRAGFPKDWVVGEKTGTCANGARNDIGFFK

AQERDYAVAVYTTAPKLSAVERDELVASVGQVITQLILSTDK

SEQ ID No. 46:
MRFIHALLLAGIAHSAYASEKLTFKTDLEKLEREKAAEIGVAIVDPQGE

IVAGHRMAQRFAMCSTFKFPLAALVFERIDSGTERGDRKLSYGPDMIVE

WSPATERFLASGHMTVLEAAQAAVQLSDNGATNLLLREIGGPAAMTQYF

RKIGDSVSRLDRKEPEMSDNTPGDLRDTTTPIAMARTVAKVLYGGALTS

TSTHTIERWLIGNQTGDATLRAGFPKDWVVGEKTGTCANGGRNDIGFFK

AQERDYAVAVYTTAPKLSAVERDELVASVGQVITQLILSTDK

SEQ ID No. 47:
MRFIHALLLAGIAHSAYASEKLTFKTDLEKLEREKAAQIGVAIVDPQGE

IVAGHRMAQRFAMCSTFKFPLAALVFERIDSGTERGDRKLSYGPDMIVK

WSPATERFLASGHMTVLEAAQAAVQLSDNGATNLLLREIGGPAAMTQYF

RKIGDSVSRLDRKEPEMGDNTPGDLRDTTTPIAMARTVAKVLYGGALTS

TSTHTIERWLIGNQTGDATLRAGFPKDWVVGEKTGTCANGARNDIGFFK

AQERDYAVAVYTTAPKLSAVERDELVASVGQVITQLILSTDK

SEQ ID No. 48:
MRFIHALLLAGIAHSAYASEKLTFKTDLEKLEREKAAQIGVAIVDPQGE

IVAGHRTAQRFAMCSTFKFPLAALVFERIDSGTERGDRKLSYGPDMIVK

WSPATERFLASGHMTVLEAAQAAVQLSDNGATNLLLREIGGPAAMTQYF

RKIGDSVSRLDRKEPEMGDNTPGDLRDTTTPIAMARTVAKVLYGGALTS

TSTHTIERWLIGNQTGDATLRAGFPKDWVVGEKTGTCANGGRNDIGFFK

AQERDYAVAVYTTAPKLSAVERDELVASVGQVITQLILSTDK

SEQ ID No. 49:
MRFIHALLLAGIAHSAYASEKLTFKTDLEKLEREKAAQIGVAIVDPQGE

IVAGHRTAQRFAMCSTFKFPLAALVFERIDSGTERGDRKLSYGPDMIVK

WSPATERFLASGHMTVLEAAQAAVQLSDNGATNLLLREIGGPAAMTQYF

RKIGDSVSRLDRKEPEMSDNTPGDLRDTTTPIAMARIVAKVLYGGALTS

TSTHTIERWLIGNQTGDATLRAGFPKDWVVGEKTGTCANGGRNDIGFFK

AQERDYAVAVYTTAPKLSAVERDELVASVGQVITQLILSTDK

SEQ ID No. 50:
MRFIHALLLAGIAHSAYASEKLTFKTDLEKLEREKAAQIGVAIVDPQGE

IVAGHRMAQRFAMCSTFKFPLAALVFERIDSGTERGDRKLSYGPDMIVE

WSPATERFLASGHMTVLEAAQAAVQLSDNGATNLLLREIGGPAAMTQYF

RKIGDSVSRLDRKEPEMGDNTPGDLRDTTTPIAMARTVAKVLYGGALTS

TSTHTIERWLIGNQTGDATLRAGFPKDWVVGEKTGACANGARNDIGFFK

AQERDYAVAVYTTAPKLSAVERDELVASVGQVITQLILSTDK said peptides being chosen, preferably, from the peptides of sequence SEQ ID No. 51 to SEQ ID No. 79 as defined hereafter:

| Peptide SEQ ID No. | Amino acid sequence | Position of the peptide in the GES protein(s) | Clinical interest |
|---|---|---|---|
| SEQ ID No. 51 | AAEIGVAIVDPQGEIVAGHR | 36-55 for the protein of SEQ No. 46 | carba |
| SEQ ID No. 52 | AAQIGVAIVDPQGEIVAGHR | 36-55 for the proteins of SEQ No. 34, 35, 36, 37, 38, 39, 40, 41, 42, 43, 44, 45, 47, 48, 49, 50 | ESBL |
| SEQ ID No. 53 | AGFPK | 218-222 for the proteins of SEQ No. 34, 35, 36, 37, 38, 39, 40, 41, 42, 43, 44, 45, 46, 47, 48, 49, 50 | ESBL |
| SEQ ID No. 54 | DTTTPIAMAR | 174-183 for the proteins of SEQ No. 34, 35, 36, 37, 38, 39, 40, 41, 42, 43, 44, 45, 46, 47, 48, 49, 50 | ESBL |
| SEQ ID No. 55 | DWVVGEK | 223-229 for the proteins of SEQ No. 34, 35, 36, 37, 38, 39, 40, 41, 42, 43, 44, 45, 46, 47, 48, 49, 50 | ESBL |
| SEQ ID No. 56 | DYAVAVYTTAPK | 250-261 for the proteins of SEQ No. 34, 35, 36, 37, 38, 39, 40, 41, 42, 43, 44, 45, 46, 47, 48, 49, 50 | ESBL |

| Peptide SEQ ID No. | Amino acid sequence | Position of the peptide in the GES protein(s) | Clinical interest |
|---|---|---|---|
| SEQ ID No. 57 | EIGGPAAMTQYFR | 136-148 for the proteins of SEQ No. 34, 35, 36, 37, 38, 39, 40, 41, 42, 43, 44, 45, 46, 47, 48, 49, 50 | ESBL |
| SEQ ID No. 58 | EPEMNDNTPGDLR | 161-173 for the proteins of SEQ No. 34, 35, 36, 40, 41, 42, 47, 48, 50 | ESBL |
| SEQ ID No. 59 | EPEMNDNTPGDLR | 161-173 for the proteins of SEQ No. 37, 43 | carba |
| SEQ ID No. 60 | EPEMNDNTPGDLR | 161-173 for the proteins of SEQ No. 38, 39, 45, 46, 49 | carba |
| SEQ ID No. 61 | ESEMSDNTPGDLR | 161-173 for the protein of SEQ No. 44 | carba |
| SEQ ID No. 62 | FAMCSTFK | 60-67 for the proteins of SEQ No. 34, 35, 36, 37, 38, 39, 40, 41, 42, 43, 44, 45, 46, 47, 48, 49, 50 | ESBL |
| SEQ ID No. 63 | FIHALLLAGIAHSAYASEK | 3-21 for the proteins of SEQ No. 34, 35, 36, 37, 38, 39, 40, 41, 43, 44, 45, 46, 47, 48, 49, 50 | ESBL |
| SEQ ID No. 64 | FIHALLLAGTAHSAYASEK | 3-21 for the protein of SEQ No. 42 | carba |
| SEQ ID No. 65 | FPLAALVFER | 68-77 for the proteins of SEQ No. 34, 35, 36, 37, 38, 39, 40, 41, 42, 43, 44, 45, 46, 47, 48, 49, 50 | ESBL |
| SEQ ID No. 66 | IDSGTER | 78-84 for the proteins of SEQ No. 34, 35, 36, 37, 38, 39, 40, 41, 42, 43, 44, 45, 46, 47, 48, 49, 50 | |
| SEQ ID No. 67 | IGDSVSR | 150-156 for the proteins of SEQ No. 34, 35, 36, 37, 38, 39, 40, 41, 42, 43, 44, 45, 46, 47, 48, 49, 50 | ESBL |
| SEQ ID No. 68 | LSAVER | 262-267 for the proteins of SEQ No. 34, 35, 36, 37, 38, 39, 40, 41, 42, 43, 44, 45, 46, 47, 48, 49, 50 | ESBL |
| SEQ ID No. 69 | LSYGPDMIVEWSPATER | 89-105 for the proteins of SEQ No. 34, 36, 37, 38, 40, 41, 42, 44, 45, 46, 50 | ESBL |
| SEQ ID No. 70 | LSYGPDMIVK | 89-98 for the proteins of SEQ No. 35, 39, 43, 47, 48, 49 | carba |
| SEQ ID No. 71 | NDIGFFK | 239-245 for the proteins of SEQ No. 34, 35, 36, 37, 38, 39, 40, 41, 42, 43, 44, 45, 46, 47, 48, 49, 50 | ESBL |
| SEQ ID No. 72 | TDLEK | 26-30 for the proteins of SEQ No. 34, 35, 36, 37, 38, 39, 40, 41, 42, 43, 44, 45, 46, 47, 48, 49, 50 | ESBL |
| SEQ ID No. 73 | TGACANGAR | 230-238 for the protein of SEQ No. 50 | carba |
| SEQ ID No. 74 | TGTCANGAR | 230-238 for the proteins of SEQ No. 41, 45, 47 | carba |
| SEQ ID No. 75 | TGTCANGGR | 230-238 for the proteins of SEQ No. 34, 35, 36, 37, 38, 39, 42, 43, 44, 46, 48, 49 | ESBL |
| SEQ ID No. 76 | TGTCANGSR | 230-238 for the protein of SEQ No. 40 | carba |
| SEQ ID No. 77 | VLYGGALTSTSTHTIER | 188-204 for the proteins of SEQ No. 34, 35, 36, 37, 38, 39, 40, 41, 42, 43, 44, 45, 46, 47, 48, 49, 50 | ESBL |
| SEQ ID No. 78 | WLIGNQTGDATLR | 205-217 for the proteins of SEQ No. 34, 35, 36, 37, 38, 39, 40, 41, 42, 43, 44, 45, 46, 47, 48, 49, 50 | ESBL |
| SEQ ID No. 79 | WSPATER | 99-105 for the proteins of SEQ No. 34, 35, 36, 37, 38, 39, 40, 41, 42, 43, 44, 45, 46, 47, 48, 49, 50 | carba |

In the clinical interest column, the ESBL and carba entries correspond to the GES beta-lactamase activities which the corresponding peptide makes it possible to detect. Therefore, the detection of a carba peptide will indicate the presence of a carbapenemase beta-lactamase capable of hydrolysing carbapenems.

If no peptide referred to as carba is detected, the detection of a peptide referred to as ESBL will indicate the presence of a beta-lactamase with an extended spectrum (ESBL) capable of hydrolysing penicillins, first-generation cephalosporins such as cephaloridine and cefalotin, and at least one antibiotic from the oxyimino-beta-lactam class such as cefotaxime, ceftazidime or monobactams such as aztreonam.

The detection of a mechanism of resistance to carbapenems induced by a GES protein is thus characterised by the detection of at least one resistance-marking carba peptide chosen from the sequences SEQ ID No. 51, 59, 60, 61, 64, 70, 73, 74, 76, 79.

The detection of a mechanism of resistance to carbapenems induced by the expression of an IMP protein is characterised by the detection of at least one peptide belonging to an IMP protein and to its different sequence variants SEQ ID No. 80 to SEQ ID No. 105.

SEQ ID No. 80:
MSKLSVFFIFLFCSIATAAESLPDLKIEKLDEGVYVHTSFEEVNGWG
VVPKHGLVVLVNAEAYLIDTPFTAKDTEKLVTWFVERGYKIKGSISS
HFHSDSTGGIEWLNSRSIPTYASELTNELLKKDGKVQATNSFSGVNY
WLVKNKIEVFYPGPGHTPDNVVVWLPERKILFGGCFIKPYGLGNLGD
ANIEAWPKSAKLLKSKYGKAKLVVPSHSEVGDASLLKLTLEQAVKGL
NESKKPSKPSN

SEQ ID No. 81:
MKKLSVFFMPLFCSIAASGEALPDLKIEKLDEGVYVHTSFEEVNGWG
VVPKHGLVVLVNTDAYLIDTPFTAKDTEKLVTWFVERGYKIKGSISS
HFHSDSTGGIEWLNSQSIPTYASELTNELLKKDGKVQAKNSFSGASY
WLVKKKIEIFYPGPGHTPDNVVVWLPEHRVLFGGCFVKPYGLGNLGD
ANLEAWPKSAKLLVSKYGKAKLVVPSHSEVGDASLLKRTLEQAVKGL
NESKKLSKPSN

SEQ ID No. 82:
MSKLSVFFIFLFCSIATAAEPLPDLKIEKLDEGVYVHTSFEEVNGWG
VVPKHGLVVLVDAEAYLIDTPFTAKDTEKLVTWFVERGYKIKGSISS
HFHSDSTGGIEWLNSQSIPTYASELTNELLKKDGKVQAKNSFGGVNY
WLVKNKIEVFYPGPGHTPDNLVVWLPERKILFGGCFIKPYGLGNLGD
ANLEAWPKSAKLLISKYGKAKLVVPSHSEAGDASLLKLTLEQAVKGL
NESKKPSKLSN

SEQ ID No. 83:
MKKLFVLCVCFLCSITAAGAALPDLKIEKLEEGVYVHTSFEEVNGWG
VVSKHGLVVLVNTDAYLIDTPFTATDTEKLVNWFVERGYKIKGTISS
HFHSDSTGGIEWLNSQSIPTYASELTNELLKKDGKVQAKNSFSGVSY
WLVKNKIEVFYPGPGHTQDNVVVWLPEKKILFGGCFVKPDGLGNLGD
ANLEAWPKSAKILMSKYGKAKLVVSSHSEIGDASLLKRTWEQAVKGL
NESKKPSQPSN

SEQ ID No. 84:
MSKLFVFFMFLFCSITAAAESLPDLKIEKLDEGVYVHTSFEEVNGWG
VVPKHGLVVLVNTEAYLIDTPFTAKDTEKLVTWFVERGYKIKGSISS
HFHSDSTGGIEWLNSQSIPTYASELTNELLKKDGKVQAKNSFSGASY
WLVKKKIEVFYPGPGHTPDNVVVWLPENRVLFGGCFVKPYGLGNLGD
ANVEAWPKSAKLLMSKYGKAKLVVPSHSEVGDASLLKRTLEQAVKGL
NESKKPSKPSN

SEQ ID No. 85:
MSKLFVFFMFLFCSITAAGESLPDLKIEKLDEGVYVHTSFEEVNGWG
VIPKHGLVVLVNTDAYLIDTPFTAKDTENLVNWFVERGYRIKGSISS
HFHSDSTGGIEWLNSQSIPTYASELTNELLKKDGKVQAKYSFSGVSY
WLVKKKIEVFYPGPGHAPDNVVVWLPENRVLFGGCFVKPYGLGNLGD
ANLEAWPKSAKLLMSKYSKAKLVVPSHSDIGDSSLLKLTWEQTVKGF
NESKKSTTAH

SEQ ID No. 86:
MKKLFVLCVFFFCNIAVAEESLPDLKIEKLEEGVYVHTSFEEVKGWS
VVTKHGLVVLVKNDAYLIDTPITAKDTEKLVNWFVERGYKIKGSIST
HFHGDSTAGIEWLNSQSIPTYASELTNELLKKDNKVQAKHSFNGVSY
SLIKNKIEVFYPGPGHTQDNVVVWLPEKKILFGGCFVKPDGLGYLGD
ANLEAWPKSAKILMSKYGKAKLVVSSHSDIGDVSLLKRTWEQAVKGL
NESKKSSQPSD

SEQ ID No. 87:
MNKLSVFFMFMFCSITAAGESLPDLKIEKLDEGVYVHTSFEEVNGWG
VVPKHGLVVLVNTEAYLIDTPFTAKDTEKLVTWFVERGYKIKGSISS
HFHSDSTGGIEWLNSQSIPTYASELTNELLKKDGKVQAKNSFSGGSY
WLVNNKIEVFYPGPGHTPDNVVVWLPENRVLFGGCFVKPYGLGNLGD
ANLEAWPKSAKILMSKYGKAKLVVSSHSETGNASLLKLTWEQAVKGL
KESKKPSLPSN

SEQ ID No. 88:
MKKLFVLCVFFLCNIAAADDSLPDLKIEKLEKGVYVHTSFEEVKGWG
VVIKHGLVVLVKNDAYLIDTPITAKDTEKLVNWFIEHGYRIKGSIST
HFHGDSTAGIEWLNSQSISTYASELTNELLKKDNKVQATNSFSGVSY
SLIKNKIEVFYPGPGHTQDNVVVWLPEKKILFGGCFVKPDGLGNLGD
ANLEAWPKSAKILMSKYGKAKLVVSSHSEIGNASLLQRTWEQAVKGL
NESKKPLQPSS

SEQ ID No. 89:
MKKLFVLCVFLFCSITAAGESLPDLKIEKLEEGVYVHTSFEEVNGWG
VVSKHGLVILVNTDAYLIDTPFTAKDTEKLVTWFVERGYKIKGSISS
HFHSDSTGGIEWLNSQSIPTYASELTNDLLKQNGKVQAKNSFSGVSY
WLVKNKIEVFYPGPGHTQDNVVVWLPEKKILFGGCFVKPYGLGNLDD
ANVVAWPHSAEILMSRYGNAKLVVPSHSDIGDASLLKLTWEQAVKGL
KESKKPSEPSN

SEQ ID No. 90:
MSKLSVFFIFLFCSIATAAESLPDLKIEKLDEGVYVHTSFKEVNGWG
VVPKHGLVVLVNAEAYLIDTPFTAKDTEKLVTWFVERGYKIKGSISS
HFHSDSTGGIEWLNSRSIPTYASELTNELLKKDGKVQATNSFSGVNY
WLVKNKIEVFYPGPGHTPDNVVVWLPERKILFGGCFIKPYGLGNLGD
ANIEAWPKSAKLLKSKYGKAKLVVPSHSEVGDASLLKLTLEQAVKGL
NESKKPSKPSN

SEQ ID No. 91:
MKKLFVLCVCFLCSITAAGAALPDLKIEKLEEGVYVHTSFEEVNGWG
VVSKHGLVVLVNTDAYLIDTPFTATDTEKLVNWFVERGYKIKGTISS
HFHSDSTGGIEWLNSQSIPTYASELTNELLKKDGKVQAKNSFSGVSY
WLVKNKIEVFYPGPGHTQDNVVVWLPEKKILFGGCFVKPDGLGNLGD
ANLEAWPKSAKILMSKYVKAKLVVSSHSEIGDASLLKRTWEQAVKGL
NESKKPSQPSN

SEQ ID No. 92:
MKKLFVLCVCFLCSITAAGAALPDLKIEKLEEGVYVHTSFEEVNGWG
VVSKHGLVVLVNTDAYLIDTPFTATDTEKLVNWFVERGYKIKGTISS
HFHSDSTGGIEWLNSQSIPTYASELTNELLKKDGKVQAKNSFSGVSY
WLVKNKIEVFYPGPGHTQDNVVVWLPEKKILFGGCFVKPDGLGNLGD
ANLEAWPKSAKILMSKYGKAKLVVSSHSEIGDASLLKRTWEQAVKGL
NESRKPSQPSN

SEQ ID No. 93:
MSKLSVFFIFLFCSIATAAESLPDLKIEKLDEGVYVHTSFEEVNGWG
VVPKHGLVVLVNAEAYLIDTPFTAKDTEKLVTWFVERGYKIKGSISS
HFHSDSTGGIEWLNSRSIPTYASELTNELLKKDGKVQATNSFSGVNY
WLVKNKIEVFYPGPGHTPDNVVVWLPERKILFGGCFIKPYGLGNLSD
ANIEAWPKSAKLLKSKYGKAKLVVPGHSEVGDASLLKLTLEQAVKGL
NESKKPSKPSN

SEQ ID No. 94:
MSKLSVFFIFLFCSIATAAEPLPDLKIEKLDEGVYVHTSFEEVNGWG
VFPKHGLVVLVDAEAYLIDTPFTAKDTEKLVTWFVERGYKIKGSISS
HFHSDSTGGIEWLNSQSIPTYASELTNELLKKDGKVQAKNSFGGVNY
WLVKNKIEVFYPGPGHTPDNLVVWLPERKILFGGCFIKPYGLGNLGD
ANLEAWPKSAKLLISKYGKAKLVVPSHSEAGDASLLKLTLEQAVKGL
NESKKPSKLSN

SEQ ID No. 95:
MKKLFVLCVFVFCSITVAGETLPNLRVEKLEEGVYVHTSYEEVKGWG
VVIKHGLVVLIGADAYLIDTPFTAKDTEKLVNWFVERGYKIKGTVSS
HFHSDSTGGIEWLNSQSIPTYASELTNELLKKDGKVQAKNSFDGVSY
WLAKDKIEVFYPGPGHTQDNVVVWLPEKEILFGGCFVKPHGLGNLGD
ANLEAWPESAKILMEKYGKAKLVVSGHSETGDATHLKRTWEQAVKGL
KESKKTLQPSN

SEQ ID No. 96:
MSKLSVFFIFLFCSIATAAESLPDLKIEKLDEGVYVHTSFEEVNGWG
VVPKHGLVVLVNAEAYLIDTPFTAKDTEKLVTWFVERGYKIKGSISS
HFHSDSTGGIGWLNSRSIPTYASELTNELLKKDGKVQATNSFSGVNY
WLVKNKIEVFYPGPGHTPDNVVVWLPERKILFGGCFIKPYGLGNLGD
ANIEAWPKSAKLLKSKYGKAKLVVPGHSEVGDASLLKLTLEQAVKGL
NESKKPSKPSN

SEQ ID No. 97:
MSKLSVFFIFLFCSIATAAESLPDLKIEKLDEGVYVHTSFEEVNGWG
VVPKHGLVVLVNAEAYLIDTPFTAKDTEKLVTWFVERGYKIKGSISS
HFHSDSTGGIEWLNSRSIPTYASELTNELLKKDGKVQATNSFSGVNY
WLVKNKIEVFYPGPGHTPDNVVVWLPERKILFGGCFIKPYGLGNLGD
ANIEAWPKSAKLLKSKYGKAKLVVPGHSEVGDASLLKLTLEQAVKGL
NESKKPSKPSN

SEQ ID No. 98:
MSKLSVFFIFLFCSIATAAESLPDLKIEKLDEGVYVHTSFEEVNGWG
VFPKHGLVVLVNAEAYLIDTPFTAKDTEKLVTWFVERGYKIKGSISS
HFHSDSTGGIEWLNSRSIPTYASELTNELLKKDGKVQATNSFSGVNY
WLVKNKIEVFYPGPGHTPDNVVVWLPERKILFGGCFIKPYGLGNLGD
ANIEAWPKSAKLLKSKYGKAKLVVPGHSEVGDASLLKLTLEQAVKGL
NESKKPSKPSN

SEQ ID No. 99:
MKKLFVLCIFLFCSITAAGASLPDLKIEKLEEGVYVHTSFEEVNGWG
VVSKHGLVVLVNTDAYLIDTPFTAKDTEKLVNWFVERGYKIKGSISS
HFHSDSTGGIEWLNSQSIPTYASVLTNELLKKDGKVQAKNSFSGVSY
WLVKNKIEVFYPGPGHTQDNVVVWLPKNKILFGGCFVKPYGLGNLDD
ANVEAWPHSAEKLISKYGNAKLVVPSHSDIGDASLLKLTWEQAVKGL
NESKKSNTVH

SEQ ID No. 100:
MKKLFVLCVCFLCSITAAGAALPDLKIEKLEEGVYVHTSFEEVNGWG
VFSKHGLVVLVNTDAYLIDTPFTATDTEKLVNWFVERGYKIKGTISS
HFHSDSTGGIEWLNSQSIPTYASELTNELLKKDGKVQAKNSFSGVSY
WLVKNKIEVFYPGPGHTQDNVVVWLPEKKILFGGCFVKPDGLGNLGD
ANLEAWPKSAKILMSKYVKAKLVVSSHSEIGDASLLKRTWEQAVKGL
NESKKPSQPSN

SEQ ID No. 101:
MKKLFVLCIFLFCSITAAGASLPDLKIEKLEEGVYVHTSFEEVNGWG
VASKHGLVVLVNTDAYLIDTPFTAKDTEKLVNWFVERGYKIKGSISS
HFHSDSTGGIEWLNSQSIPTYASVLTNELLKKDGKVQAKNSFSGVSY
WLVKNKIEVFYPGPGHTQDNVVVWLPKNKILFGGCFVKPYGLGNLDD
ANVEAWPHSAEKLISKYGNAKLVVPSHSDIGDASLLKLTWEQAVKGL
NESKKSNTVH

SEQ ID No. 102:
MKKLFVLCVCFLCSITAAGARLPDLKIEKLEEGVYVHTSFEEVNGWG
VVSKHGLVVLVNTDAYLIDTPFTATDTEKLVNWFVERGYKIKGTISS
HFHSDSTGGIEWLNSQSIPTYASELTNELLKKDGKVQAKNSFSGVSY

-continued
WLVKNKIEVFYPGPGHTQDNVVVWLPEKKILFGGCFVKPDGLGNLGD

ANLEAWPKSAKILMSKYVKAKLVVSSHSEIGDASLLKRTWEQAVKGL

NESKKPSQPSN

SEQ ID No. 103:
MKKLFVLCIFLFLSITASGEVLPDLKIEKLEEGVYLHTSFEEVSGWG

VVTKHGLVVLVNNDAYLIDTPFTNKDTEKLVAWFVGRGFTIKGSVSS

HFHSDSTGGIEWLNSQSIPTYASELTNELLKKNGKVQATNSFSGVSY

WLVKNKIEIFYPGPGHTQDNVVVWLPENKILFGGCFVKPDGLGNLDD

ANLKAWPKSAKILMSKYGKAKLVVSGHSEIGNASLLKLTWEQAVKGL

KESKKPLLPSN

SEQ ID No. 104:
MKKLFVLCVCFFCSITAAGAALPDLKIEKLEEGVFVHTSFEEVNGWG

VVTKHGLVVLVNTDAYLIDTPFTATDTEKLVNWFVERGYEIKGTISS

HFHSDSTGGIEWLNSQSIPTYASELTNELLKKSGKVQAKYSFSEVSY

WLVKNKIEVFYPGPGHTQDNLVVWLPESKILFGGCFIKPHGLGNLGD

ANLEAWPKSAKILMSKYGKAKLVVSSHSEKGDASLMKRTWEQALKGL

KESKKTSSPSN

SEQ ID No. 105:
MKKLFVLCIFLFCSITAAGESLPDLKIEKLEDGVYVHTSFEEVNGWG

VVTKHGLVFLVNTDAYLIDTPFAAKDTEKLVNWFVERGYKIKGSISS

HFHSDSSGGIEWLNSQSIPTYASELTNELLKKNGKVQAKNSFSGVSY

WLLKNKIEIFYPGPGHTQDNVVVWLPEKKILFGGCFVKPYGLGNLDD

ANVEAWPHSAEILMSRYGNAKLVVPSHSDVGDASLLKLTWEQAVKGL

KESKKPSQPSN said peptides being chosen, preferably, from the peptides of sequence SEQ ID No. 106, SEQ ID No. 108 to SEQ ID No. 130, SEQ ID No. 133 to SEQ ID No. 173, SEQ ID No. 175 to SEQ ID No. 180, as defined hereafter:

| Peptide SEQ ID No. | Amino acid sequence | Position of the peptide in the IMP protein(s) |
|---|---|---|
| SEQ ID No. 106 | DTENLVNWFVER | 73-84 for the protein of SEQ No. 85 |
| SEQ ID No. 107 | EILFGGCFVK | 170-179 for the protein of SEQ No. 95 |
| SEQ ID No. 108 | EVNGWGVVPK | 42-51 for the proteins of SEQ No. 80, 81, 82, 84, 87, 90, 93, 96, 97 |
| SEQ ID No. 109 | GDASLMK | 219-225 for the protein of SEQ No. 104 |
| SEQ ID No. 110 | GFNESK | 234-239 for the protein of SEQ No. 85 |
| SEQ ID No. 111 | GFTIK | 85-89 for the protein of SEQ No. 103 |
| SEQ ID No. 112 | GLNESK | 234-239 for the proteins of SEQ No. 80, 81, 82, 83, 84, 86, 88, 90, 91, 93, 94, 96, 97, 98, 99, 100, 101, 102 |
| SEQ ID No. 113 | GLNESR | 234-239 for the protein of SEQ No. 92 |
| SEQ ID No. 114 | GSISSHFHSDST GGIEWLNSR | 90-110 for the proteins of SEQ No. 80, 90, 93, 97, 98 |
| SEQ ID No. 115 | GSISSHFHSDST GGIGWLNSR | 90-110 for the protein of SEQ No. 96 |
| SEQ ID No. 116 | GVYVHTSFEEVK | 33-44 for the proteins of SEQ No. 86, 88 |
| SEQ ID No. 117 | GWGVVTK | 45-51 for the proteins of SEQ No. 88, 95, 103, 104, 105 |
| SEQ ID No. 118 | GWSVVTK | 45-51 for the protein of SEQ No. 86 |
| SEQ ID No. 119 | GYEIK | 85-89 for the protein of SEQ No. 104 |
| SEQ ID No. 120 | HGLVFLVNTDA YLIDTPFAAK | 52-72 for the protein of SEQ No. 105 |
| SEQ ID No. 121 | HGLVILVNTDA YLIDTPFTAK | 52-72 for the protein of SEQ No. 89 |
| SEQ ID No. 122 | HGLVVLIGADA YLIDTPFTAK | 52-72 for the protein of SEQ No. 95 |
| SEQ ID No. 123 | HGLVVLVDAEA YLIDTPFTAK | 52-72 for the proteins of SEQ No. 82, 94 |
| SEQ ID No. 124 | HGLVVLVK | 52-59 for the proteins of SEQ No. 86, 88 |
| SEQ ID No. 125 | HGLVVLVNAEA YLIDTPFTAK | 52-72 for the proteins of SEQ No. 80, 90, 93, 96, 97, 98 |
| SEQ ID No. 126 | HGLVVLVNNDA YLIDTPFTNK | 52-72 for the protein of SEQ No. 103 |
| SEQ ID No. 127 | HGLVVLVNTDA YLIDTPFTAK | 52-72 for the proteins of SEQ No. 81, 85, 99, 101 |
| SEQ ID No. 128 | HGLVVLVNTEA YLIDTPFTAK | 52-72 for the proteins of SEQ No. 84, 87 |
| SEQ ID No. 129 | HSFNGVSYSLIK | 134-145 for the protein of SEQ No. 86 |
| SEQ ID No. 130 | IEVFYPGPGHTQ DNVVVWLPK | 148-168 for the proteins of SEQ No. 99, 101 |
| SEQ ID No. 131 | ILFGGCFIK | 171-179 for the proteins of SEQ No. 80, 82, 90, 93, 94, 96, 97, 98, 104 |
| SEQ ID No. 132 | ILFGGCFVK | 171-179 for the proteins of SEQ No. 83, 86, 88, 89, 91, 92, 95, 99, 100, 101, 102, 103, 105 |
| SEQ ID No. 133 | ILMEK | 200-204 for the protein of SEQ No. 95 |
| SEQ ID No. 134 | ILMSK | 200-204 for the proteins of SEQ No. 83, 86, 87, 88, 91, 92, 100, 102, 103, 104 |

| Peptide SEQ ID No. | Amino acid sequence | Position of the peptide in the IMP protein(s) |
|---|---|---|
| SEQ ID No. 135 | LDEGVYVHTSFK | 30-41 for the protein of SEQ No. 90 |
| SEQ ID No. 136 | LEEGVYVHTSFEEVK | 30-44 for the protein of SEQ No. 86 |
| SEQ ID No. 137 | LEEGVYVHTSYEEVK | 30-44 for the protein of SEQ No. 95 |
| SEQ ID No. 138 | LFVLCVCFLCSITAAGAR | 4-21 for the protein of SEQ No. 102 |
| SEQ ID No. 139 | LLISK | 200-204 for the proteins of SEQ No. 82, 94 |
| SEQ ID No. 140 | LLMSK | 200-204 for the proteins of SEQ No. 84, 85 |
| SEQ ID No. 141 | LLVSK | 200-204 for the protein of SEQ No. 81 |
| SEQ ID No. 142 | LPDLK | 22-26 for the proteins of SEQ No. 80, 81, 82, 83, 84, 85, 86, 87, 88, 89, 90, 91, 92, 93, 94, 96, 97, 98, 99, 100, 101, 102, 103, 104, 105 |
| SEQ ID No. 143 | LTLEQAVK | 226-233 for the proteins of SEQ No. 80, 82, 90, 93, 94, 96, 97, 98 |
| SEQ ID No. 144 | LTWEQAVK | 226-233 for the proteins of SEQ No. 87, 89, 99, 101, 103, 105 |
| SEQ ID No. 145 | LTWEQTVK | 226-233 for the protein of SEQ No. 85 |
| SEQ ID No. 146 | LVAWFVGR | 77-84 for the protein of SEQ No. 103 |
| SEQ ID No. 147 | LVNWFIEHGYR | 77-87 for the protein of SEQ No. 88 |
| SEQ ID No. 148 | LVNWFVER | 77-84 for the proteins of SEQ No. 83, 85, 86, 91, 92, 95, 99, 100, 101, 102, 104, 105 |
| SEQ ID No. 149 | LVTWFVER | 77-84 for the proteins of SEQ No. 80, 81, 82, 84, 87, 89, 90, 93, 94, 96, 97, 98 |
| SEQ ID No. 150 | LVVPGHSEVGDASLLK | 210-225 for the proteins of SEQ No. 93, 96, 97 |
| SEQ ID No. 151 | LVVPSHSDIGDASLLK | 210-225 for the proteins of SEQ No. 89, 99, 101 |
| SEQ ID No. 152 | LVVPSHSDIGDSSLLK | 210-225 for the protein of SEQ No. 85 |
| SEQ ID No. 153 | LVVPSHSDVGDASLLK | 210-225 for the protein of SEQ No. 105 |
| SEQ ID No. 154 | LVVPSHSEAGDASLLK | 210-225 for the proteins of SEQ No. 82, 94 |
| SEQ ID No. 155 | LVVPSHSEVGDASLLK | 210-225 for the proteins of SEQ No. 80, 81, 84, 90, 98 |
| SEQ ID No. 156 | LVVSGHSEIGNASLLK | 210-225 for the protein of SEQ No. 103 |
| SEQ ID No. 157 | LVVSGHSETGDATHLK | 210-225 for the protein of SEQ No. 95 |
| SEQ ID No. 158 | LVVSSHSDIGDVSLLK | 210-225 for the protein of SEQ No. 86 |
| SEQ ID No. 159 | LVVSSHSEIGDASLLK | 210-225 for the proteins of SEQ No. 83, 91, 92, 100, 102 |
| SEQ ID No. 160 | LVVSSHSEIGNASLLQR | 210-226 for the protein of SEQ No. 88 |
| SEQ ID No. 161 | LVVSSHSEK | 210-218 for the protein of SEQ No. 104 |
| SEQ ID No. 162 | LVVSSHSETGNASLLK | 210-225 for the protein of SEQ No. 87 |
| SEQ ID No. 163 | NDAYLIDTPITAK | 60-72 for the proteins of SEQ No. 86, 88 |
| SEQ ID No. 164 | NSFDGVSYWLAK | 134-145 for the protein of SEQ No. 95 |
| SEQ ID No. 165 | NSFGGVNYWLVK | 134-145 for the proteins of SEQ No. 82, 94 |
| SEQ ID No. 166 | NSFSGASYWLVK | 134-145 for the proteins of SEQ No. 81, 84 |
| SEQ ID No. 167 | NSFSGGSYWLVNNK | 134-147 for the protein of SEQ No. 87 |
| SEQ ID No. 168 | NSFSGVSYWLLK | 134-145 for the protein of SEQ No. 105 |
| SEQ ID No. 169 | NSFSGASYWLVK | 134-145 for the proteins of SEQ No. 83, 89, 91, 92, 99, 100, 101, 102, 103 |
| SEQ ID No. 170 | SIPTYASELTNELLK | 111-125 for the proteins of SEQ No. 80, 81, 82, 83, 84, 85, 86, 87, 90, 91, 92, 93, 94, 95, 96, 97, 98, 100, 102, 103, 104, 105 |
| SEQ ID No. 171 | TLEQAVK | 227-233 for the proteins of SEQ No. 80, 81, 82, 84, 90, 93, 94, 96, 97, 98 |
| SEQ ID No. 172 | TWEQALK | 227-233 for the protein of SEQ No. 104 |
| SEQ ID No. 173 | TWEQAVK | 227-233 for the proteins of SEQ No. 83, 86, 87, 88, 89, 91, 92, 95, 99, 100, 101, 102, 103, 105 |
| SEQ ID No. 174 | VLFGGCFVK | 171-179 for the proteins of SEQ No. 81, 84, 85, 87 |
| SEQ ID No. 175 | VQATNSFSGVNYWLVK | 130-145 for the proteins of SEQ No. 80, 90, 93, 96, 97, 98 |

| Peptide SEQ ID No. | Amino acid sequence | Position of the peptide in the IMP protein(s) |
| --- | --- | --- |
| SEQ ID No. 176 | VQATNSFSGVSYSLIK | 130-145 for the protein of SEQ No. 88 |
| SEQ ID No. 177 | VQATNSFSGVSYWLVK | 130-145 for the protein of SEQ No. 103 |
| SEQ ID No. 178 | YGNAK | 205-209 for the proteins of SEQ No. 89, 99, 101, 105 |
| SEQ ID No. 179 | YSFSEVSYWLVK | 134-145 for the protein of SEQ No. 104 |
| SEQ ID No. 180 | YSFSGVSYWLVK | 134-145 for the protein of SEQ No. 85 |

The detection of a mechanism of resistance to carbapenems induced by the expression of the IND protein is characterised by the detection of at least one peptide belonging to the IND protein and to its different sequence variants SEQ ID No. 181 to SEQ ID No. 187.

```
SEQ ID No. 181:
MKKSIRFFIVSILLSPFASAQVKDFVIEPPIKNNLHIYKTFGVF
GGKEYSANSMYLVTKKGVVLFDVPWEKIQYQSLMDTIKKRHNLP
VVAVFATHSHDDRAGDLSFFNNKGIKTYATAKTNEFLKKDGKAT
STEIIKTGKPYRIGGEEFVVDFLGEGHTADNVVVWFPKYNVLDG
GCLVKSNSATDLGYIKEANVEQWPKTINKLKAKYSKATLIIPGH
DEWKGGGHVEHTLELLNKK

SEQ ID No. 182:
MKKSIQLLMMSMFLSPLINAQVKDFVIEPPVKPNLYLYKSFGVF
GGKEYSANAVYLTTKKGVVLFDVPWQKEQYQTLMDTIQKRHHLP
VIAVFATHSHDDRAGDLSFYNQKGIKTYATAKTNELLKKDGKAT
STEIIKTGKPYKIGGEEFMVDFLGEGHTVDNVVVWFPKYKVLDG
GCLVKSRTATDLGYTGEANVKQWPETMRKLKTKYAQATLVIPGH
DEWKGGGHVQHTLDLLDKNKKPE

SEQ ID No. 183:
MKKSIQLLMMSMFLSPLINAQVKDFVIEPPVKPNLYLYKSFGVF
GGKEYSANAVYLTTKKGVVLFDVPWQKEQYQTLMDTIQKRHHLP
VIAVFATHSHDDRAGDLSFYNQKGIKTYATAKTNELLKKDGKAT
STEIIKTGKPYKIGGEEFMVDFLGEGHTVDNVVVWFPKYKVLDG
GCLVKSRTATDLGYTGEANVKQWPETMRKLKTKYAQATLVIPGH
EEWKGGGHVQHTLDLLDKNKKPE

SEQ ID No. 184:
MKKRIQFFMVSMMLSSLFSAQVKDFVIEPPIKKNLHIYKTFGVF
GGKEYSANSVYLVTQKGVVLFDVPWEKVQYQSLMDTIQKRHNLP
VIAVFATHSHDDRAGDLSFFNNKGIKTYATSKTNEFLKKDGKAT
STEIIKTGKPYRIGGEEFVVDFLGEGHTADNVVVWFPKYNVLDG
GCLVKSKAATDLGYIKEANVEQWPKTINKLKSKYSKASLVIPGH
DEWKGGGHVKHTLELLNKK

SEQ ID No. 185:
MRKNVRIFTVLSLFLINFFNAQARDFVIEQPFGKQLYLYKTFGVF
DGKEYSTNALYLVTKKGVVLFDVPWQKTQYQSLMDTIKKRHNLPV
IAVFATHSHSDRAGDLSFYNKKGIPTYATAKTNELLKKEGKATSS
KLTKIGKKYKIGGEEFTVDFLGEGHTADNVVVWFPKYNVLDGGCL
VKSSAAVDLGYTGEANVEQWPATMKKLQAKYPSTAKVIPGHDEWK
GNDHVKHTLELLDQQKQ

SEQ ID No. 186:
MKKRIQFFMVSMMLAPMFNAQVKDFVIEPPIKNNLHIYKTFGVFG
GKEYSANSVYLVTKKGVVLFDVPWEKAQYQSLMDTIKKRHNLPVI
AVFATHSHDDRAGDLSFFNNKGIKTYATSKTNEFLKKDGKATSTE
IIKTGKPYRIGGEEFTVDFLGEGHTADNVVVWFPKYNVLDGGCLV
KSNSATDLGYIKEANVEQWPITIDKLKAKYSKATLIIPGHDDWKG
GGHVEHTLELLNKK

SEQ ID No. 187:
MKRRIQFFMVSMMLTPLFSAQVKDFVIEPPIKKNLYIYKTFGVFG
GKEYSANSVYLVTKTGVVLFDVPWEKAQYQSLMDTIKKRHNLPVV
AVFATHSHDDRAGDLSFFNNKGIKTYATPKTNQFLKRDGKATSTE
LIKPGKPYRFGGEEFVVDFLGEGHTADNVVVWFPKYKVLDGGCLV
KSNSATDLGYIKEANLEQWPKTMHKLKTKYSEAVLIIPGHDEWKG
GGHVEHTLELLDKK
``` said peptides being chosen, preferably, from the peptides of sequence SEQ ID No. 188 to SEQ ID No. 197, SEQ ID No. 200, SEQ ID No. 201, SEQ ID No. 203 to SEQ ID No. 262, as defined hereafter:

| Peptide SEQ ID No. | Amino acid sequence | Position of the peptide in the IND protein(s) |
| --- | --- | --- |
| SEQ ID No. 188 | AATDLGYIK | 184-192 for the protein of SEQ No. 184 |
| SEQ ID No. 189 | AGDLSFFNNK | 102-111 for the proteins of SEQ No. 181, 184, 186, 187 |
| SEQ ID No. 190 | AGDLSFYNK | 103-111 for the protein of SEQ No. 185 |

-continued

| Peptide SEQ ID No. | Amino acid sequence | Position of the peptide in the IND protein(s) |
|---|---|---|
| SEQ ID No. 191 | AGDLSFYNQK | 102-111 for the proteins of SEQ No. 182, 183 |
| SEQ ID No. 192 | AQYQSLMDTIK | 72-82 for the proteins of SEQ No. 186, 187 |
| SEQ ID No. 193 | ASLVIPGHDEWK | 213-224 for the protein of SEQ No. 184 |
| SEQ ID No. 194 | ATLIIPGHDDWK | 213-224 for the protein of SEQ No. 186 |
| SEQ ID No. 195 | ATLIIPGHDEWK | 213-224 for the protein of SEQ No. 181 |
| SEQ ID No. 196 | ATSSK | 132-136 for the protein of SEQ No. 185 |
| SEQ ID No. 197 | ATSTEIIK | 131-138 for the proteins of SEQ No. 181, 182, 183, 184, 186 |
| SEQ ID No. 198 | ATSTELIK | 131-138 for the protein of SEQ No. 187 |
| SEQ ID No. 199 | ATSTELIKPGK | 131-141 for the protein of SEQ No. 187 |
| SEQ ID No. 200 | ATSTELIKPGKPYR | 131-144 for the protein of SEQ No. 187 |
| SEQ ID No. 201 | DFVIEPPIK | 24-32 for the proteins of SEQ No. 181, 184, 186, 187 |
| SEQ ID No. 202 | DFVIEPPVK | 24-32 for the proteins of SEQ No. 182, 183 |
| SEQ ID No. 203 | DFVIEPPVKPNLYLYK | 24-39 for the proteins of SEQ No. 182, 183 |
| SEQ ID No. 204 | DFVIEQPFGK | 25-34 for the protein of SEQ No. 185 |
| SEQ ID No. 205 | EANLEQWPK | 193-201 for the protein of SEQ No. 187 |
| SEQ ID No. 206 | EANVEQWPITIDK | 193-205 for the protein of SEQ No. 186 |
| SEQ ID No. 207 | EANVEQWPK | 193-201 for the proteins of SEQ No. 181, 184 |
| SEQ ID No. 208 | EQYQTLMDTIQK | 72-83 for the proteins of SEQ No. 182, 183 |
| SEQ ID No. 209 | EYSANAVYLTTK | 48-59 for the proteins of SEQ No. 182, 183 |
| SEQ ID No. 210 | EYSANSMYLVTK | 48-59 for the protein of SEQ No. 181 |
| SEQ ID No. 211 | EYSANSVYLVTK | 48-59 for the proteins of SEQ No. 186, 187 |
| SEQ ID No. 212 | EYSANSVYLVTQK | 48-60 for the protein of SEQ No. 184 |
| SEQ ID No. 213 | EYSTNALYLVTK | 49-60 for the protein of SEQ No. 185 |
| SEQ ID No. 214 | FFIVSILLSPFASAQVK | 7-23 for the protein of SEQ No. 181 |
| SEQ ID No. 215 | GGGHVEHTLELLDK | 225-238 for the protein of SEQ No. 187 |

-continued

| Peptide SEQ ID No. | Amino acid sequence | Position of the peptide in the IND protein(s) |
|---|---|---|
| SEQ ID No. 216 | GGGHVEHTLELLNK | 225-238 for the proteins of SEQ No. 181, 186 |
| SEQ ID No. 217 | GGGHVK | 225-230 for the protein of SEQ No. 184 |
| SEQ ID No. 218 | GGGHVQHTLDLLDK | 225-238 for the proteins of SEQ No. 182, 183 |
| SEQ ID No. 219 | GIPTYATAK | 113-121 for the protein of SEQ No. 185 |
| SEQ ID No. 220 | GNDHVK | 226-231 for the protein of SEQ No. 185 |
| SEQ ID No. 221 | GVVLFDVPWEK | 61-71 for the proteins of SEQ No. 181, 184, 186, 187 |
| SEQ ID No. 222 | GVVLFDVPWQK | 62-72 for the protein of SEQ No. 185; protein of sequence SEQ ID No. 182; 61-71 for the protein of sequence SEQ ID No. 183 |
| SEQ ID No. 223 | HHLPVIAVFATHSHDDR | 85-101 for the proteins of SEQ No. 182, 183 |
| SEQ ID No. 224 | HNLPVIAVFATHSHDDR | 85-101 for the proteins of SEQ No. 184, 186 |
| SEQ ID No. 225 | HNLPVIAVFATHSHSDR | 86-102 for the protein of SEQ No. 185 |
| SEQ ID No. 226 | HNLPVVAVFATHSHDDR | 85-101 for the proteins of SEQ No. 181, 187 |
| SEQ ID No. 227 | HTLELLDQQK | 232-241 for the protein of SEQ No. 185 |
| SEQ ID No. 228 | HTLELLNK | 231-238 for the proteins of SEQ No. 181, 184, 186 |
| SEQ ID No. 229 | IFTVLSLFLINFFNAQAR | 7-24 for the protein of SEQ No. 185 |
| SEQ ID No. 230 | IQFFMVSMMLAPMFNAQVK | 5-23 for the protein of SEQ No. 186 |
| SEQ ID No. 231 | IQFFMVSMMLSSLFSAQVK | 5-23 for the protein of SEQ No. 184 |
| SEQ ID No. 232 | IQFFMVSMMLTPLFSAQVK | 5-23 for the protein of SEQ No. 187 |
| SEQ ID No. 233 | IQYQSLMDTIK | 72-82 for the protein of SEQ No. 181 |
| SEQ ID No. 234 | NLHIYK | 34-39 for the proteins of SEQ No. 181, 184, 186 |
| SEQ ID No. 235 | NLYIYK | 34-39 for the protein of SEQ No. 187 |
| SEQ ID No. 236 | NNLHIYK | 33-39 for the proteins of SEQ No. 181, 186 |
| SEQ ID No. 237 | QLYLYK | 35-40 for the protein of SEQ No. 185 |
| SEQ ID No. 238 | QWPETMR | 198-204 for the proteins of SEQ No. 182, 183 |
| SEQ ID No. 239 | SFGVFGGK | 40-47 for the proteins of SEQ No. 182, 183 |

-continued

| Peptide SEQ ID No. | Amino acid sequence | Position of the peptide in the IND protein(s) |
|---|---|---|
| SEQ ID No. 240 | SIQLLMMSMFLSPLINAQVK | 4-23 for the proteins of SEQ No. 182, 183 |
| SEQ ID No. 241 | SNSATDLGYIK | 182-192 for the proteins of SEQ No. 181, 186, 187 |
| SEQ ID No. 242 | TATDLGYTGEANVK | 184-197 for the proteins of SEQ No. 182, 183 |
| SEQ ID No. 243 | TFGVFDGK | 41-48 for the protein of SEQ No. 185 |
| SEQ ID No. 244 | TFGVFGGK | 40-47 for the proteins of SEQ No. 181, 184, 186, 187 |
| SEQ ID No. 245 | TGKPYK | 139-144 for the proteins of SEQ No. 182, 183 |
| SEQ ID No. 246 | TGKPYR | 139-144 for the proteins of SEQ No. 181, 184, 186 |
| SEQ ID No. 247 | TGVVLFDVPWEK | 60-71 for the protein of SEQ No. 187 |
| SEQ ID No. 248 | TNEFLK | 121-126 for the proteins of SEQ No. 181, 184, 186 |
| SEQ ID No. 249 | TNELLK | 122-127 for the protein of SEQ No. 185; 121-126 for the proteins of sequence SEQ ID No. 182, 183 |
| SEQ ID No. 250 | TNQFLK | 121-126 for the protein of SEQ No. 187 |
| SEQ ID No. 251 | TQYQSLMDTIK | 73-83 for the protein of SEQ No. 185 |
| SEQ ID No. 252 | TYATAK | 116-121 for the protein of SEQ No. 185; 115-120 for the proteins of sequence SEQ ID No. 181, 182, 183 |
| SEQ ID No. 253 | TYATPK | 115-120 for the protein of SEQ No. 187 |
| SEQ ID No. 254 | TYATSK | 115-120 for the proteins of SEQ No. 184, 186 |
| SEQ ID No. 255 | VIPGHDEWK | 217-225 for the protein of SEQ No. 185; 216-224 for the protein of sequence SEQ ID No. 182; 216-224 for the protein of sequence SEQ ID No. 184 |
| SEQ ID No. 256 | VLDGGCLVK | 173-181 for the proteins of SEQ No. 181, 182, 183, 184, 186, 187; 174-182 for the protein of sequence SEQ ID No. 185 |
| SEQ ID No. 257 | VQYQSLMDTIQK | 72-83 for the protein of SEQ No. 184 |
| SEQ ID No. 258 | YAQATLVIPGHDEWK | 210-224 for the protein of SEQ No. 182 |
| SEQ ID No. 259 | YAQATLVIPGHEEWK | 210-224 for the protein of SEQ No. 183 |
| SEQ ID No. 260 | YNVLDGGCLVK | 171-181 for the proteins of SEQ No. 181, 184, 186; 172-182 for the protein of sequence SEQ No. 185 |
| SEQ ID No. 261 | YPSTAK | 211-216 for the protein of SEQ No. 185 |
| SEQ ID No. 262 | YSEAVLIIPGHDEWK | 210-224 for the protein of SEQ No. 187 |

The detection of a mechanism of resistance to carbapenems induced by the expression of the SME protein is characterised by the detection of at least one peptide belonging to the SME protein and to its different sequence variants SEQ ID No. 263 to SEQ ID No. 265.

```
SEQ ID No 263:
MSNKVNFKTASFLFSVCLALSAFNAHANKSDAAAKQIKKLEEDFDG

RIGVFAIDTGSGNTFGYRSDERFPLCSSFKGFLAAAVLERVQQKKL

DINQKVKYESRDLEYHSPITTKYKGSGMTLGDMASAALQYSDNGAT

NIIMERFLGGPEGMTKFMRSIGDNEFRLDRWELELNTAIPGDKRDT

STPKAVANSLNKLALGNVLNAKEKAIYQNWLKGNTTGDARIRASVP

ADWVVGDKTGSCGAYGTANDYAVIWPKNRAPLIVSIYTTRKSKDDK

HSDKTIAEASRIAIQAID

SEQ ID No. 264:
MSNKVNFKTASFLFSVCLALSAFNAHANKSDAAAKQIKKLEEDFDG

RIGVFAIDTGSGNTFGYRSDERFPLCSSFKGFLAAAVLERVQQKKL

DINQKVKYESRDLEYYSPITTKYKGSGMTLGDMASAALQYSDNGAT

NIIMERFLGGPEGMTKFMRSIGDNEFRLDRWELELNTAIPGDKRDT

STPKAVANSLNKLALGNVLNAKVKAIYQNWLKGNTTGDARIRASVP

ADWVVGDKTGSCGAYGTANDYAVIWPKNRAPLIVSIYTTRKSKDDK

HSDKTIAEASRIAIQAID

SEQ ID No. 265:
MSNKVNFKTASFLFSVCLALSAFNAHANKSDAAAKQIKKLEEDFDG

RIGVFAIDTGSGNTFGYRSDERFPLCSSFKGFLAAAVLERVQQKKL

DINQKVKYESRDLEYHSPITTKYKGSGMTLGDMASAALQYSDNGAT

NIIMERFLGGPEGMTKFMRSIGDNEFRLDRWELELNTAIPGDKRDT

STPKAVANSLNKLALGNVLNAKVKAIYQNWLKGNTTGDARIRASVP

ADWVVGDKTGSCGAIGTANDYAVIWPKNRAPLIVSIYTTRKSKDDK

HSDKTIAEASRIAIQAID
``` said peptides being chosen, preferably, from the peptides of sequence SEQ ID No. 266 to SEQ ID No. 287 as defined hereafter:

| Peptide SEQ ID No. | Amino acid sequence | Position of the peptide in the SME protein(s) |
|---|---|---|
| SEQ ID No. 266 | AIYQNWLK | 209-216 for the proteins of SEQ No. 263, 264, 265 |
| SEQ ID No. 267 | APLIVSIYTTR | 260-270 for the proteins of SEQ No. 263, 264, 265 |
| SEQ ID No. 268 | ASVPADWVVGDK | 227-238 for the proteins of SEQ No. 263, 264, 265 |
| SEQ ID No. 269 | AVANSLNK | 189-196 for the proteins of SEQ No. 263, 264, 265 |
| SEQ ID No. 270 | DLEYHSPITTK | 104-114 for the proteins of SEQ No. 263, 265 |
| SEQ ID No. 271 | DLEYYSPITTK | 104-114 for the protein of SEQ No. 264 |
| SEQ ID No. 272 | DTSTPK | 183-188 for the proteins of SEQ No. 263, 264, 265 |
| SEQ ID No. 273 | FLGGPEGMTK | 145-154 for the proteins of SEQ No. 263, 264, 265 |
| SEQ ID No. 274 | GFLAAAVLER | 77-86 for the proteins of SEQ No. 263, 264, 265 |
| SEQ ID No. 275 | GNTTGDAR | 217-224 for the proteins of SEQ No. 263, 264, 265 |
| SEQ ID No. 276 | IGVFAIDTGSGNTFGYR | 48-64 for the proteins of SEQ No. 263, 264, 265 |
| SEQ ID No. 277 | LALGNVLNAK | 197-206 for the proteins of SEQ No. 263, 264, 265 |
| SEQ ID No. 278 | LDINQK | 92-97 for the proteins of SEQ No. 263, 264, 265 |
| SEQ ID No. 279 | LEEDFDGR | 40-47 for the proteins of SEQ No. 263, 264, 265 |
| SEQ ID No. 280 | SDAAAK | 30-35 for the proteins of SEQ No. 263, 264, 265 |
| SEQ ID No. 281 | SIGDNEFR | 158-165 for the proteins of SEQ No. 263, 264, 265 |
| SEQ ID No. 282 | TASFLFSVCLALSAFNAHANK | 9-29 for the proteins of SEQ No. 263, 264, 265 |
| SEQ ID No. 283 | TGSCGAIGTANDYAVIWPK | 239-257 for the protein of SEQ No. 265 |
| SEQ ID No. 284 | TGSCGAYGTANDYAVIWPK | 239-257 for the proteins of SEQ No. 263, 264 |
| SEQ ID No. 285 | TIAEASR | 281-287 for the proteins of SEQ No. 263, 264, 265 |
| SEQ ID No. 286 | WELELNTAIPGDK | 169-181 for the proteins of SEQ No. 263, 264, 265 |
| SEQ ID No. 287 | FPLCSSFK | 69-76 for the proteins of SEQ No. 263, 264, 265 |

The detection of a mechanism of resistance to carbapenems induced by the expression of a VIM protein is characterised by the detection of at least one peptide belonging to a VIM protein and to its different sequence variants SEQ ID No. 288 to SEQ ID No. 313.

```
SEQ ID No. 288:
MFKLLSKLLVYLTASIMAIASPLAFSVDSSGEYPTVSEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSTRR

LAEVEGNEIPTHSLEGLSSSGDAVRFGPVELFYPGAAHSTDNLVVYV

PSASVLYGGCAIYELSRTSAGNVADADLAEWPTSIERIQQHYPEAQF

VIPGHGLPGGLDLLKHTTNVVKAHTNRSVVE

SEQ ID No. 289:
MFKLLSKLLVYLTASIMAIASPLAFSVDSSGEYPTVSEIPVGEVRLY

QIADGVWSHIATKSFDGAVYPSNGLIVRDGDELLLIDTAWGAKNTAA

LLAEIEKQIGLPVTRAVSTHFHDDRVGGVDVLRAAGVATYASPSTRR
```

LAEVEGSEIPTHSLEGLSSSGDAVRFGPVELFYPGAAHSTDNLVVYV

PSASVLYGGCAIYELSRTSAGNVADADLAEWPTSIERIQQHYPEAQF

VIPGHGLPGGLDLLKHTTNVVKAHTNRSVVE

SEQ ID No. 290:
MLKVISSLLVYMTASVMAVASPLAHSGEPSGEYPTVNEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSTRR

LAEAEGNEIPTHSLEGLSSSGDAVRFGPVELFYPGAAHSTDNLVVYV

PSANVLYGGCAVHELSRTSAGNVADADLAEWPTSVERIQKHYPEAEV

VIPGHGLPGGLDLLQHTANVVKAHKNRSVAE

SEQ ID No. 291:
MLKVISSLLVYMTASVMAVASPLAHSGEPSGEYPTVNEIPVGEVRLY

QIADGVWSHIATQSFDGAVYPSNGLIVRDGDELLLIDTAWGAKNTAA

LLAEIEKQIGLPVTRAVSTHFHDDRVGGVDVLRKAGVATYASPSTRR

LAEAEGNEIPTHSLEGLSSSGDAVRFGPVELFYPGAAHSTDNLVVYV

PSANVLYGGCAVLALSRTSAGNVADADLAEWPTSVERIQKHYPEAEV

VIPGHGLPGGLDLLQHTANVVTAHKNRSVAE

SEQ ID No. 292:
MFKLLSKLLVYLTASIMAIASPLAFSVDSSGEYPTVSEIPVGEVRLY

QIADGVWSHIATRSFDGAVYPSNGLIVRDGDELLLIDTAWGAKNTAA

LLAEIEKQIGLPVTRAVSTHFHDDRVGGVDVLRAAGVATYASPSTRR

LAEVEGSEIPTHSLEGLSSSGDAVRFGPVELFYPGAAHSTDNLVVYV

PSASVLYGGCAIYELSRTSAGNVADADLAEWPTSIERIQQHYPEAQF

VIPGHGLPGGLDLLKHTTNVVKAHTNRSVVE

SEQ ID No. 293:
MFKLLSKLLVYLTASIMAIASPLAFSVDSSGEYPTVSEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSARR

LAEVEGNEIPTHSLEGLSSSGDAVRFGPVELFYPGAAHSTDNLVVYV

PSASVLYGGCAIYELSRTSAGNVADADLAEWPTSIERIQQHYPEAQF

VIPGHGLPGGLDLLKHTTNVVKAHTNRSVVE

SEQ ID No. 294:
MFKLLSKLLVYLTASIMAIASPLAFSVDSSGEYPTVSEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSIRR

LAEVEGNEIPTHSLEGLSSSGDAVRFGPVELFYPGAAHSTDNLVVYV

PSASVLYGGCAIYELSRTSAGNVADADLAEWPTSIERIQQHYPEAQF

VIPGHGLPGGLDLLKHTTNVVKAHTNRSVVE

SEQ ID No. 295:
MFKLLSKLLVYLTASIMAIASPLAFSVDSSGEYPTVSEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSTRR

LAEVEGNEIPTHSLEGLSSSGDAVRFGPVELFYPGAAHSTDNLVVYV

PSASVLYGGCAIYELSRTSAGNVADADLAEWPTSIERIQQHYPEAQY

VIPGHGLPGGLDLLKHTTNVVKAHTNRSVVE

SEQ ID No. 296:
MFKLLSKLLVYLTASIMAIASPLAFSVDSSGEYPTVSEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSTRR

LAEVEGSEIPTHSLEGLSSSGDAVRFGPVELFYPGAAHSTDNLVVYV

PSASVLYGGCAIYELSRTSAGNVADADLAEWPTSIERIQQHYPEAQF

VIPGHGLPGGLDLLKHTTNVVKAHTNRSVVE

SEQ ID No. 297:
MLKVISSLLVYMTASVMAVASPLAHSGEPSGEYPTVNEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSTRR

LAEAEGNEIPTHSLEGLSSSGDAVRFGPVELFYPGAAHSTDNLVVYV

PSANVLYGGCAVHELSRTSAGNVADADLAEWPTSVERIQKHYPEAEV

VIPGHGLPGGLDLLQHTANVVKAHKNRSVAE

SEQ ID No. 298:
MLKVISSLLVYMTASVMAVASPLAHSGEPSGEYPTVNEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSTRR

LAEAEGNEIPTHSLEGLSSSGDAVRFGPVELFYPGAAHSTDNLVVYV

PSANVLYGGCAVHELSSTSAGNVADADLAEWPTSIERIQQHYPEAQF

VIPGHGLPGGLDLLKHTTNVVKAHTNRSVVE

SEQ ID No. 299:
MLKVISSLLFYMTASLMAVASPLAHSGESRGEYPTVSEIPVGEVRLY

QIDDGVWSHIATHTFDGVVYPSNGLIVRDGDELLLIDTAWGTKNTVA

LLAEIEKQIGLPVTRSVSTHFHDDRVGGVDALRAAGVATYASPSTRR

LAEAEGNEVPTHSLEGLSSSGDAVRFGPVELFYPGAAHSTDNLVVYV

PSANVLYGGCAVLELSRTSAGNVADADLAEWPGSVERIQQHYPEAEV

VIPGHGLPGGLDLLQHTANVVKAHTNRSVAE

SEQ ID No. 300:
MFKLLSKLLVYLTASMMAIASPLAFSVDSSGEYPTVSEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSTRR

LAEVEGNEIPTHSLEGLSSSGDAVRFGPVELFYPGAAHSTDNLVVYV

PSASVLYGGCAIYELSRTSAGNVADADLAEWPTSIERIQQHYPEAQF

VIPGHGLPGGLDLLKHTTNVVKAHTNRSVVE

SEQ ID No. 301:
MFKLLSKLLVYLTASIMAIASPLAFSVDSSGEYPTVSEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSTRR

LAEVEGNEIPTHSLEGLSSSGDAVRFGPVELFYPGAAHSTDNLVVYV

PSASVLFGGCAIYELSRTSAGNVADADLAEWPTSIERIQQHYPEAQF

VIPGHGLPGGLDLLKHTTNVVKAHTNRSVVE

SEQ ID No. 302:
MFKLLSKLLVYLTASIMAIASPLAFSVDSSGEYPTVSEIPVGEVRLY

QIADGVWLHIATQSFDGAVYPSNGLIVRDGDELLLIDTAWGAKNTAA

LLAEIEKQIGLPVTRAVSTHFHDDRVGGVDVLRAAGVATYASPSTRR

LAEVEGNEIPTHSLEGLSSSGDAVRFGPVELFYPGAAHSTDNLVVYV

PSASVLYGGCAIYELSRTSAGNVADADLAEWPTSIERIQQHYPEAQF

VIPGHGLPGGLDLLKHTTNVVKAHTNRSVVE

SEQ ID No. 303:
MFKLLSKLLVYLTASIMAIASPLAFSVDSSGEYPTVSEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSTRR

LAEVEGNEIPTHSLEGLSSSGDAVRFGPVELFYPGAAHSTDNLVVYV

PSASVLYGGCAIYELSSTSAGNVADADLAEWPTSIERIQQHYPEAQF

VIPGHGLPGGLDLLKHTTNVVKAHTNRSVVE

SEQ ID No. 304:
MLKVISSLLVYMTASVMAVASPLAHSGEPSGEYPTVNEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSTRR

LAEAEGNEIPTHSLEGLSSSGDAVRFGPVELFYPGAAHSTDNLVVYV

PSAKVLYGGCAVHELSRTSAGNVADADLAEWPTSVERIQKHYPEAEV

VIPGHGLPGGLDLLQHTANVVKAHKNRSVAE

SEQ ID No. 305:
MFKLLSKLLVYLTASIMAIASPLAFSVDSSGEYPTVSEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSTRR

LAEVEGNEIPTHSLEGLSSSGDAVRFGPVELFYPGAAHSTDNLVVYV

PSASVLYGGCAIYELSLTSAGNVADADLAEWPTSIERIQQHYPEAQF

VIPGHGLPGGLDLLKHTTNVVKAHTNRSVVE

SEQ ID No. 306:
MLKVISSLLVYMTASVMAVASPLAHSGEPSGEYPTVNEIPVGEVRLY

QIADGVWSHIATQSFDGAVYPSNGLIVRDGDELLLIDTAWGAKNTAA

LLAEIEKQIGLPVTRAVSTHFHDDRVGGVDVLRKAGVATYASPSTRR

LAEAEGNEIPTHSLEGLSSSGDAVRFGPVELFYPGAAHSTDNLVVYV

PSANVLYGGCAVLALSRTSAGNVADADLAEWPTSVERIQKHYPEAQF

VIPGHGLPGGLDLLKHTTNVVKAHTNRSVVE

SEQ ID No. 307:
MLKVISSLLVYMTASVMAVASPLAHSGEPSGEYPTVNEIPVGEVRLY

QIADGVWSHISTQSFDGAVYPSNGLIVRDGDELLLIDTAWGAKNTAA

LLAEIEKQIGLPVTRAVSTHFHDDRVGGVDVLRAAGVATYASPSTRR

LAEAEGNEIPTHSLEGLSSSGDAVRFGPVELFYPGAAHSTDNLVVYV

PSANVLYGGCAVHELSSTSAGNVADADLAEWPTSVERIQKHYPEAEV

VIPGHGLPGGLDLLQHTANVVKAHKNRSVAE

SEQ ID No. 308:
MLKVISSLLVYMTASVMAVASPLAHSGEPSGEYPTVNEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSTRR

LAEAEGNEIPTHSLEGLSSSGDAVRFGPVELFYPGAAHSTDNLVVYV

PSANVLYGGCAVLELSRTSAGNVADADLAEWPTSVERIQKHYPEAEV

VIPGHGLPGGLDLLQHTANVVKAHKNRSVAE

SEQ ID No. 309:
MFKLLSKLLVYLTASIMAIASPLAFSVDSSGEYPTVNEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSTRR

LAEVEGNEIPTHSLEGLSSSGDAVRFGPVELFYPGAAHSTDNLVVYV

PSASVLYGGCAIYELSRTSAGNVADADLAEWPTSIERIQQHYPEAQF

VIPGHGLPGGLDLLKHTTNVVKAHTNRSVVE

SEQ ID No. 310:
MLKVISSLLVYMTASVMAVASPLAHSGEPSGEYPTVNEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSTRR

LAEAEGNEIPTHSLEGLSSSGDAVRFGPVELFYPGAAHSTDNLVVYV

PSANVLYGGCAVHELSSTSAGNVADADLAEWPTSVERIQKHYPEAEV

VIPGHGLPGGLDLLQHTANVVKAHKNRSVAE

SEQ ID No. 311:
MFQIRSFLVGISAFVMAVLGSAAYSAQPGGEYPTVDDIPVGEVRLYK

IGDGVWSHIATQKLGDTVYSSNGLIVRDADELLLIDTAWGAKNTVAL

LAEIEKQIGLPVTRSISTHFHDDRVGGVDVLRAAGVATYTSPLTRQL

AEAAGNEVPAHSLKALSSSGDVVRFGPVEVFYPGAAHSGDNLVVYVP

AVRVLFGGCAVHEASRESAGNVADANLAEWPATIKRIQQRYPEAEVV

IPGHGLPGGLELLQHTTNVVKTHKVRPVAE

SEQ ID No. 312:
MFKLLSKLLVYLTASIMAIASPLAFSVDSSGEYPTVSEIPVGEVRLY

QIADGVWSHIATRSFDGAVYPSNGLIVRDGDELLLIDTAWGAKNTAA

LLAEIEKQIGLPVTRAVSTHFHDDRVGGVDVLRAAGVATYASPSTRR

LANEIPTHSLEGLSSSGDAVRFGPVELFYPGAAHSTDNLVVYVPSAS

VLYGGCAIYELSRTSAGNVADADLAEWPTSIERIQQHYPEAQFVIPG

HGLPGGLDLLKHTTNVVKAHTNRSVVE

SEQ ID No. 313:
MLKVISSLLVYMTASVMAVASPLAHSGEPSGEYPTVNEIPVGEVRLY

QIADGVWSHIATQSFDGAVYPSNGLIVRDGDELLLIDTAWGAKNTAA

LLAEIEKQIGLPVTRAVSTHFHDDRVGGVDVLRAAGVATYASPSTRR

LAEAEGNEIPTHSLEGLSSSGDAVRFGPVELFYPGAAHSTDNLVVYV

PSANVLYGGCAVLELSSTSAGNVADADLAEWPTSVERIQKHYPEAEV

VIPGHGLPGGLDLLQHTANVVKAHKNRSVAE said peptides being chosen, preferably, from the peptides of sequence SEQ ID No. 314 to SEQ ID No. 346 as defined hereafter:

| Peptide SEQ ID No. | Amino acid sequence | Position of the peptide in the VIM protein(s) |
|---|---|---|
| SEQ ID No. 314 | AAGVATYASPSAR | 128-140 for the protein of SEQ No. 293 |
| SEQ ID No. 315 | AAGVATYASPSIR | 128-140 for the protein of SEQ No. 294 |
| SEQ ID No. 316 | AAGVATYASPSTR | 128-140 for the proteins of SEQ No. 288, 289, 290, 292, 295, 296, 297, 298, 299, 300, 301, 302, 303, 304, 305, 307, 308, 309, 310, 312, 313 |
| SEQ ID No. 317 | AAGVATYTSPLTR | 127-139 for the protein of SEQ No. 311 |
| SEQ ID No. 318 | AGVATYASPSTR | 129-140 for the proteins of SEQ No. 288, 289, 290, 291, 292, 295, 296, 297, 298, 299, 300, 301, 302, 303, 304, 305, 306, 307, 308, 309, 310, 312, 313 |
| SEQ ID No. 319 | AHTNR | 254-258 for the protein of SEQ No. 312; 258-262 for the proteins of sequence SEQ ID No. 288, 289, 292, 293, 294, 295, 296, 298, 299, 300, 301, 302, 303, 305, 306, 309 |
| SEQ ID No. 320 | ALSSSGDVVR | 156-165 for the protein of SEQ No. 311 |
| SEQ ID No. 321 | AVSTHFHDDR | 110-119 for the proteins of SEQ No. 288, 289, 290, 291, 292, 293, 294, 295, 296, 297, 298, 300, 301, 302, 303, 304, 305, 306, 307, 308, 309, 310, 312, 313 |
| SEQ ID No. 322 | DADELLLIDTAWGAK | 75-89 for the protein of SEQ No. 311 |
| SEQ ID No. 323 | DADELLLIDTAWGAK | 76-90 for the proteins of SEQ No. 288, 289, 290, 291, 292, 293, 294, 295, 296, 297, 298, 300, 301, 302, 303, 304, 305, 306, 307, 308, 309, 310, 312, 313 |
| SEQ ID No. 324 | DGDELLLIDTAWGTK | 76-90 for the protein of SEQ No. 299 |
| SEQ ID No. 325 | ESAGNVADANLAEWPATIK | 205-223 for the protein of SEQ No. 311 |
| SEQ ID No. 326 | GEYPTVSEIPVGEVR | 31-45 for the proteins of SEQ No. 288, 289, 292, 293, 294, 295, 296, 299, 300, 301, 302, 303, 305, 312 |
| SEQ ID No. 327 | HTTNVVK | 247-253 for the protein of SEQ No. 312; 251-257 for the proteins of sequence SEQ ID No. 288, 289, 292, 293, 294, 295, 296, 298, 300, 301, 302, 303, 305, 306, 309; 250-256 for the protein of sequence SEQ ID No. 311 |
| SEQ ID No. 328 | IGDGVWSHIATQK | 48-60 for the protein of SEQ No. 311 |
| SEQ ID No. 329 | LANEIPTHSLEGLSSSGDAVR | 142-162 for the protein of SEQ No. 312 |
| SEQ ID No. 330 | LGDTVYSSNGLIVR | 61-74 for the protein of SEQ No. 311 |
| SEQ ID No. 331 | LYQIADGVWSHIATK | 46-60 for the protein of SEQ No. 289 |
| SEQ ID No. 332 | LYQIADGVWSHIATR | 46-60 for the proteins of SEQ No. 292, 312 |
| SEQ ID No. 333 | NTAALLAEIEK | 91-101 for the proteins of SEQ No. 288, 289, 290, 291, 292, 293, 294, 295, 296, 297, 298, 300, 301, 302, 303, 304, 305, 306, 307, 308, 309, 310, 312, 313 |

-continued

| Peptide SEQ ID No. | Amino acid sequence | Position of the peptide in the VIM protein(s) |
|---|---|---|
| SEQ ID No. 334 | NTVALLAEIEK | 90-100 for the protein of SEQ No. 311; 91-101 for the protein of sequence SEQ ID No. 299 |
| SEQ ID No. 335 | QIGLPVTR | 102-109 for the proteins of SEQ No. 288, 289, 290, 291, 292, 293, 294, 295, 296, 297, 298, 299, 300, 301, 302, 303, 304, 305, 306, 307, 308, 309, 310, 312, 313; 101-108 for the protein of sequence SEQ ID No. 311 |
| SEQ ID No. 336 | QLAEAAGNEVPAHSLK | 140-155 for the protein of SEQ No. 311 |
| SEQ ID No. 337 | SFDGAVYPSNGLIVR | 61-75 for the proteins of SEQ No. 288, 289, 290, 291, 292, 293, 294, 295, 296, 297, 298, 300, 301, 302, 303, 304, 305, 306, 307, 308, 309, 310, 312, 313 |
| SEQ ID No. 338 | SISTHFHDDR | 109-118 for the protein of SEQ No. 311 |
| SEQ ID No. 339 | SVSTHFHDDR | 110-119 for the protein of SEQ No. 299 |
| SEQ ID No. 340 | TSAGNVADADLAEWPGSVER | 206-225 for the protein of SEQ No. 299 |
| SEQ ID No. 341 | TSAGNVADADLAEWPTSIER | 202-221 for the protein of SEQ No. 312; 206-225 for the protein of sequence SEQ ID No. 288, 289, 292, 293, 294, 295, 296, 298, 300, 301, 302, 303, 305, 309 |
| SEQ ID No. 342 | TSAGNVADADLAEWPTSVER | 206-225 for the proteins of SEQ No. 290, 291, 297, 304, 306, 307, 308, 310, 313 |
| SEQ ID No. 343 | VGGVDALR | 120-127 for the protein of SEQ No. 299 |
| SEQ ID No. 344 | VGGVDVLR | 120-127 for the proteins of SEQ No. 288, 289, 291, 292, 293, 294, 295, 296, 297, 298, 300, 301, 302, 303, 304, 305, 306, 307, 308, 309, 310, 312, 313; 119-126 for the protein of sequence SEQ ID No. 311 |
| SEQ ID No. 345 | VLFGGCAVHEASR | 192-204 for the protein of SEQ No. 311 |
| SEQ ID No. 346 | VLYGGCAVHELSR | 193-205 for the proteins of SEQ No. 290, 297, 304 |

The detection of a mechanism of resistance to carbapenems and/or to cephalosporins induced by the expression of an OXA protein is characterised by the detection of at least one peptide belonging to an OXA protein and to its different sequence variants SEQ ID No. 347 to SEQ ID No. 508.

SEQ ID No. 347:
MSRLLLSGLLATGLLCAVPASAASGCFLYADGNGQTLSSEGDCSS

QLPPASTFKIPLALMGYDSGFLVNEEHPALPYKPSYDGWLPAWRE

TTTPRRWETYSVVWFSQQITEWLGMERFQQYVDRFDYGNRDLSGN

PGKHDGLTQAWLSSSLAISPEEQARFLGKMVSGKLPVSAQTLQYT

ANILKVSEVEGWQIHGKTGMGYPKKLDGSLNRDQQIGWFVGWASK

PGKQLIFVHTVVQKPGKQFASIKAKEEVLAALPAQLKKL

SEQ ID No. 348:
IACLSSTALAGSITENTSWNKEFSAEAVNGVFVLCKSSSKSCATN

DLARASKEYLPASTFKIPNAIIGLETGVIKNEHQVFKWDGKPRAM

KQWERDLTLRGAIQVSAVPVFQQIAREVGEVRMQKYLKKFSYGNQ

NISGGIDKFWLEDQLRISAVNQVEFLESLYLNKLSASKENQLIVK

EALVTEAAPEYLVHSKTGFSGVGTESNPGVAWWVGWVEKETEVYF

FAFNMDIDNESKLPLRKSIPTKIMESEGIIGG

SEQ ID No. 349:
MKKILLLHMLVFVSATLPISSVASDEVETLKCTIIADAITGNTLY

ETGECARRVSPCSSFKLPLAIMGFDSGILQSPKSPTWELKPEYNP

SPRDRTYKQVYPALWQSDSVVWFSQQLTSRLGVDRFTEYVKKFEY
GNQDVSGDSGKHNGLTQSWLMSSLTISPKEQIQFLLRFVAHKLPV
SEAAYDMAYATIPQYQAAEGWAVHGKSGSGWLRDNNGKINESRPQ
GWFVGWAEKNGRQVVFARLEIGKEKSDIPGGSKAREDILVELPVL
MGNK

SEQ ID No. 350:
MAIRIFAILFSIFSLATFAHAQEGTLERSDWRKFFSEFQAKGTIV
VADERQADRAMLVFDPVRSKKRYSPASTFKIPHTLFALDAGAVRD
EFQIFRWDGVNRGFAGHNQDQDLRSAMRNSTVWVYELFAKEIGDD
KARRYLKKIDYGNAGPSTSNGDYWIEGSLAISAQEQIAFLRKLYR
NELPFRVEHQRLVKDLMIVEAGRNWILRAKTGWEGRMGWWVGWVE
WPTGSVFFALNIDTPNRMDDLFKREAIVRAILRSIEALPPNPAVN
SDAAR

SEQ ID No. 351:
MQRSLSMSGKRHFIFAVSFVISTVCLTFSPANAAQKLSCTLVIDE
ASGDLLHREGSCDKAFAPMSTFKLPLAIMGYDADILLDATTPRWD
YKPEFNGYKSQQKPTDPTIWLKDSIVWYSQELTRRLGESRFSDYV
QRFDYGNKDVSGDPGKHNGLTHAWLASSLKISPEEQVRFLRRFLR
GELPVSEDALEMTKAVVPHFEAGDWDVQGKTGTGSLSDAKGGKAP
IGWFIGWATRDDRRVVFARLTVGARKGEQPAGPAARDEFLNTLPA
LSENF

SEQ ID No. 352:
MKTFAAYVIIACLSSTALAGSITENTSWNKEFSAEAVNGVFVLCK
SSSKSCATNDLARASKEYLPASTFKIPNAIIGLETGVIKNEHQVF
KWDGKPRAMKQWERDLTLRGAIQVSAVPVFQQIAREVGEVRMQKY
LKKFSYGNQNISGGIDKFWLEGQLRISAVNQVEFLESLYLNKLSA
SKENQLIVKEALVTEAAPEYLVHSKTGFSGVGTESNPGVAWWVGW
VEKETEVYFFAFNMDIDNESKLPLRKSIPTKIMESEGIIGG

SEQ ID No. 353:
IACLSSTALAGSITENTSWNKEFSAEAVNGVFVLCKSSSKSCATN
DLARASKEYLPASTFKIPNAIIGLETGVIKNEHQVFKWDGKPRAM
KQWERDLTLRGAIQVSAVPVFQQITREVGEVRMQKYLKKFSYGNQ
NISGGIDKFWLEDQLRISAVNQVEFLESLYLNKLSASKENQLIVK
EALVTEAAPEYLVHSKTGFSGVGTESNPGVAWWVGWVEKETEVYF
FAFNMDIDNESKLPLRKSIPTKIMESEGIIGG

SEQ ID No. 354:
IACLSSTALAGSITENTSWNKEFSAEAVNGVFVLCKSSSKSCATN
DLARASKEYLPASTFKIPSAIIGLETGVIKNEHQVFKWDGKPRAM
KQWERDLTLRGAIQVSAVPVFQQIAREVGEVRMQKYLKKFSYGNQ
NISGGIDKFWLEGQLRISAVNQVEFLESLYLNKLSASKENQLIVK
EALVTEAAPEYLVHSKTGFSGVGTESNPGVAWWVGWVEKETEVYF
FAFNMDIDNESKLPLRKSIPTKIMESEGIIGG

SEQ ID No. 355:
MIIRFLALLFSAVVLVSLGHAQEKTHESSNWGKYFSDFNAKGTIV
VVDERTNGNSTSVYNESRAQQRYSPASTFKIPHTLFALDAGAVRD
EFHVFRWDGAKRSFAGHNQDQNLRSAMRNSTVWVYQLFAKEIGEN
KARSYLEKLNYGNADPSTKSGDYWIDGNLAISANEQISILKKLYR
NELPFRVEHQRLVKDLMIVEAKRDWILRAKTGWDGQMGWWVGWVE
WPTGPVFFALNIDTPNRMEDLHKREAIARAILQSVNALPPN

SEQ ID No. 356:
MAIRIFAILFSTFVFGTFAHAQEGMRERSDWRKFFSEFQAKGTIV
VADERQTDRVILVFDQVRSEKRYSPASTFKIPHTLFALDAGAARD
EFQVFRWDGIKRSFAAHNQDQDLRSAMRNSTVWIYELFAKEIGED
KARRYLKQIDYGNADPSTSNGDYWIDGNLAIAAQEQIAFLRKLYH
NELPFRVEHQRLVKDLMIVEAGRNWILRAKTGWEGRIGWWVGWVE
WPTGPVFFALNIDTPNRMDDLFKREAIVRAILRSIEALPPNPAVN
SDAAR

SEQ ID No. 357:
MKTFAAYVITACLSSTALASSITENTSWNKEFSAEAVNGVFVLCK
SSSKSCATNNLARASKEYLPASTFKIPSAIIGLETGVIKNEHQVF
KWDGKPRAMKQWERDLSLRGAIQVSAVPVFQQIAREVGEVRMQKY
LKKFSYGNQNISGGIDKFWLEGQLRISAVNQVEFLESLFLNKLSA
SKENQLIVKEALVTEAAPEYLVHSKTGFSGVGTESNPGVAWWVGW
VEKGTEVYFFAFNMDIDNENKLPLRKSIPTKIMASEGIIGG

SEQ ID No. 358:
MKTFAAYVITACLSSTALASSITENTSWNKEFSAEAVNGVFVLCK
SSSKSCATNNLARASKEYLPASTFKIPNAIIGLETGVIKNEHQVF
KWDGKPRAMKQWERDLSLRGAIQVSAVPVFQQIAREVGEVRMQKY
LKKFSYGNQNISGGIDKFWLEDQLRISAVNQVEFLESLFLNKLSA
SKENQLIVKEALVTEAAPEYLVHSKTGFSGVGTESNPGVAWWVGW
VEKGTEVYFFAFNMDIDNENKLPLRKSIPTKIMASEGIIGG

SEQ ID No. 359:
MKTFAAYVITACLSSTALASSITENTSWNKEFSAEAVNGVFVLCK
SSSKSCATNNLARASKEYLPASTFKIPNAIIGLETGVIKNEHQVF
KWDGKPRAMKQWERDLSLRGAIQVSAVPVFQQIAREVGEVRMQKY
LKKFSYGNQNISGGIDKFGLEGQLRISAVNQVEFLESLFLNKLSA
SKENQLIVKEALVTEAAPEYLVHSKTGFSGVGTESNPGVAWWVGW
VEKGTEVYFFAFNMDIDNENKLPLRKSIPTKIMASEGIIGG

SEQ ID No. 360:
MKNTIHINFAIFLIIANIIYSSASASTDISTVASPLFEGTEGCFL
LYDASTNAEIAQFNKAKCATQMAPDSTFKIALSLMAFDAEIIDQK
TIFKWDKTPKGMEIWNSNHTPKTWMQFSVVWVSQEITQKIGLNKI
KNYLKDFDYGNQDFSGDKERNNGLTEAWLESSLKISPEEQIQFLR
KIIINHNLPVKNSAIENTIENMYLQDLDNSTKLYGKTGAGFTANRT
LQNGWFEGFIISKSGHKYVFVSALTGNLGSNLTSSIKAKKNAITI
LNTLNL

-continued

SEQ ID No. 361:
ANIIYSSASASTDISTVASPLFEGTEGCFLLYDVSTNAEIAQFNK
AKCATQMAPDSTFKIALSLMAFDAEIIDQKTIFKWDKTPKGMEIW
NSNHTPKTWMQFSVVWVSQEITQKIGLNKIKNYLKDFDYGNQDFS
GDKERNNGLTEAWLESSLKISPEEQIQFLRKIINHNLPVKNSAIE
NTIENMYLQDLENSTKLYGKTGAGFTANRTLQNGWFEGFIISKSG
HKYVFVSALTGNLGSNLTSSIKAKKNAITIL

SEQ ID No. 362:
IFSLATFAHAQEGTLERSDWRKFFSEFQAKGTIVVADERQADRAM
LVFDPVRSKKRYSPASTFKIPHTLFALDAGAVRDEFQIFRWDGVN
RGFAGHNQDQDLRSAMRNSTVWVYELFAKEIGDDKARRYLKKIDY
GNAYPSTSNGDYWIEGSLAISAQEQIAFLRKLYRNELPFRVEHQR
LVKDLMIVEAGRNWILRAKTGWEGRMGWWVGWVEWPTGSVFFALN
IDTPNRMDDLFKREAIVRAIL

SEQ ID No. 363:
MIIRFLALLFSAVVLVSLGHAQDKTHESSNWGKYFSDFNAKGTIV
VVDERTNGNSTSVYNESRAQQRYSPASTFKIPHTLFALDAGAVRD
EFHVFRWDGAKRSFAGHNQDQNLRSAMRNSTVWVYQLFAKEIGEN
KARSYLEKLNYGNADPSTKSGDYWIDGNLAISANEQISILKKLYR
NELPFRVEHQRLVKDLMIVEAKRDWILRAKTGWDGQMGWWVGWVE
WPTGPVFFALNIDTPNRMEDLHKREAIARAILQSVNALPPN

SEQ ID No. 364:
MKKFILPIFSISILVSLSACSSIKTKSEDNFHISSQQHEKAIKSY
FDEAQTQGVIIIKEGKNLSTYGNALARANKEYVPASTFKMLNALI
GLENHKATTNEIFKWDGKKRTYPMWEKDMTLGEAMALSAVPVYQE
LARRTGLELMQKEVKRVNFGNTNIGTQVDNFWLVGPLKITPVQEV
NFADDLAHNRLPFKLETQEEVEKMLLIKEVNGSKIYAKSGWGMGV
TPQVGWLTGWVEQANGKKIPFSLNLEMKEGMSGSIRNEITYKLLE
NLGII

SEQ ID No. 365:
MKKFILPIFSISILVSLSACSSIKTKSEDNFHISSQQHEKAIKSY
FDEAQTQGVIIIKEGKNLSTYGNALARANKEYVPASTFKMLNALI
GLENHKATTNEIFKWDGKKRTYPMWEKDMTLGEAMALSAVPVYQE
LARRTGLELMQKEVKRVNFGNTNIGTQVDNFWLVGPLKITPVQEV
NFADDLAHNRLPFKLETQEEVKKMLLIKEVNGSKIYAKSGWGMGV
TPQVGWLTGWVEQANGKKIPFSLNLEMKEGMTGSIRNEITYKSLE
NLGII

SEQ ID No. 366:
MNKYFTCYVVASLFLSGCTVQHNLINETPSQIVQGHNQVIHQYFD
EKNTSGVLVIQTDKKINLYGNALSRANTEYVPASTFKMLNALIGL
ENQKADINEIFKWKGEKRSFTAWEKDMTLGEAMKLSAVPVYQELA
RRIGLDLMQKEVKRIGFGNAEIGQQVDNFWLVGPLKVTPIQEVEF
VSQLAHTQLPFSEKVQANVKNMLLLEESNGYKIFGKTGWAMDIKP

-continued

QVGWLTGWVEQPDGKIVAFALKMEMRSEMPASIRNELLMKSLKQL
NII

SEQ ID No. 367:
MAIRIFAILFSIFSLATFAHAQEGTLERSDWRKFFSEFQAKGTIV
VADERQADRAMLVFDPVRSKKRYSPASTFKIPHTLFALDAGAVRD
EFQIFRWDGVNRGFAGHNQDQDLRSAMRNSTVWVYELFAKEIGDD
KARRYLKKIDYGNADPSTSNGDYCIEGSLAISAQEQIAFLRKLYR
NELPFRVEHQRLVKDLMIVEAGRNWILRAKTGWEGRMGWWVGWVE
WPTGSVFFALNIDTPNRMDDLFKREAIVRAIL

SEQ ID No. 368:
MKTFAAYVITACLSSTALASSITENTSWNKEFSAEAVNGVFVLCK
SSSKSCATNNLARASKEYLPASTFKIPNAIIGLETGVIKNEHQVF
KWDGKPRAMKQWERDLSLRGAIQVSAVPVFQQIAREVGEVRMQKY
LKKFSYGNQNISGGIDKFWLEGQLRISAVNQVEFLESLFLNKLSA
SKENQLIVKEALVTEAAPEYLVHSKTGFSGVGTESNPGVAWWVGW
VEKGTEVYFFAFNMDIDNENKLPLRKSIPTKIMASEGIIGG

SEQ ID No. 369:
MAIRFLTILLSTFFLTSFVHAQEHVLERSDWKKFFSDLRAEGAIV
ISDERQAEHALLVFGQERAAKRYSPASTFKLPHTLFALDADAVRD
EFQVFRWDGVKRSFAGHNQDQDLRSAMRNSAVWVYELFAKEIGKD
KARHYLKQIDYGNADPSTIKGDYWIDGNLEISAHEQISFLRKLYR
NQLPFQVEHQRLVKDLMITEAGRNWILRAKTGWEGRFGWWVGWVE
WPTGPVFFALNIDTPNRTDDLFKREAIARAILRSIDALPPN

SEQ ID No. 370:
MAIRIFAILFSIFSLATFAHAQEGTLERSDWRKFFSEFQAKGTIV
VADERQADRAMLVFDPVRSKKRYSPASTFKIPHTLFALDAGAVRD
EFQIFRWDGVNRGFAGHNQDQDLRSAMRNSTVWVYELFAKEIGDD
KARRYLKKIDYGNADPSTSNGDYWIEGSIAISAQEQIAFLRKLYR
NELPFRVEHQRLVKDLMIVEAGRNWILRAKTGWEGRMGWWVGWVE
WPTGSVFFALNIDTPNRMDDLFKREAIVRAILRSIEALPPNPAVN
SDAAR

SEQ ID No. 371:
MKKFILPIFSISILVSLSACSSIKTKSEDNFHISSQQHEKAIKSY
FDEAQTQGVIIIKEGKNLSTYGNALARANKEYVPASTFKMLNALI
GLENHKATTNEIFKWDGKKRTYPMWEKDMTLGEAMALSAVPVYQE
LARRTGLELMQKEVKRVNFGNTNIGTQVDNFWLVGPLKITPVQEV
NFADDLAHNRLPFKLETQEEVKKMLLIKEVNGSKIYAKSGWGMGV
TPQVGWLTGWVEQANGKKIPFSLNLEMKEGMSGSIRNEITYKSLE
NLGII

SEQ ID No. 372:
MAIRFLTILLSTFFLTSFVHAQEHVLERSDWKKFFSDLRAEGAIV
ISDERQAEHALLVFGQERAAKRYSPASTFKLPHTLFALDADAVRD
EFQVFRWDGVKRSFAGHNQDQDLRSAMRNSAVWVYELFAKEIGED

-continued
KARRYLKQIDYGNADPSTIKGDYWIDGNLEISAHEQISFLRKLYR

NQLPFQVEHQRLVKDLMITEAGRNWILRAKTGWEGRFGWWVGWVE

WPTGPVFFALNIDTPNRTDDLFKREAIARAILRSIDALPPN

SEQ ID No. 373:
MAIRFFTILLSTFFLTSFVYAQEHVVIRSDWKKFFSDLQAEGAIV

IADERQAKHTLSVFDQERAAKRYSPASTFKIPHTLFALDADAVRD

EFQVFRWDGVNRSFAGHNQDQDLRSAMRNSTVWVYELFAKDIGED

KARRYLKQIDYGNVDPSTIKGDYWIDGNLKISAHEQILFLRKLYR

NQLPFKVEHQRLVKDLMITEAGRSWILRAKTGWEGRFGWWVGWIE

WPTGPVFFALNIDTPNRTDDLFKREAIARAILRSIDALPPN

SEQ ID No. 374:
MNKYFTCYVVASLFLSGCTVQHNLINETPSQIVQGHNQVIHQYFD

EKNTSGVLVIQTDKKINLYGNALSRANTEYVPASTFKMLNALIGL

ENQKTDINEIFKWKGEKRSFTAWEKDMTLGEAMKLSAVPVYQELA

RRIGLDLMQKEVERIGFGNAEIGQQVDNFWLVGPLKVTPIQEVEF

VSQLAHTQLPFSEKVQANVKNMLLLEESNGYKIFGKTGWAAMDIK

PQVGWLTGWVEQPDGKIVAFALNMEMRSEMPASIRNELLMKSLKQ

LNII

SEQ ID No. 375:
MAIQIFAILFSTFVLATFAHAQDGTLERSDWGKFFSDFQAKGTIV

VADERQADHAILVFDQARSMKRYSPASTFKIPHTLFALDAGAVRD

EFQIFRWDGVKRSFAGHNKDQDLRSAMRNSTVWVYELFAKEIGDG

KARRYLKQIGYGNADPSTHGDYWIEGSLAISAQEQIAFLRKLYQ

NDLPFRVEHQRLVKDLMIVEAGRNWILRAKTGWEGSMGWWVGWVE

WPTGPVFFALNIDTPNRMDDLFKREAIARAILLSIEALPPNPAVH

SDAAR

SEQ ID No. 376:
MKNTIHINFAIFLIIANIIYSSASASTDISTVASQLFEGTEGCFL

LYDASTNAEIAQFNKAKCAAQMAPDSTFKIALSLMAFDAEIIDQK

TIFKWDKIPKGMEIWNSNHTPKTWMQFSVVWVSQEITQKIGLNKI

KNYLKDFDYGNQDFSGDKERNNGLTEAWLESSLKISPEEQIQFLR

KIINHNLPVRNSAIENTIDNMYLQDLENSTKLYGKTGAGFTANRT

LQNGWFEGFIISKSGHKYVFVSALTGSLGSNLTSSIKAKKNAITI

LNTLNL

SEQ ID No. 377:
MLLFMFSIISFGNENQFMKEIFERKGLNGTFVVYDLKNDKIDYYN

LDRANERFYPASSFKIFNTLIGLENGIVKNVDEMFYYYDGSKVFL

DSWAKDSNLRYAIKVSQVPAYKKLARELGKERMQEGLNKLNYGNK

EIGSEIDKFWLEGPLKISAMEQVKLLNLLSQSKLPFKLENQEQVK

DITILEKKDDFILHGKTGWATDNIWPIGWFVGWIETSDNIYSFAI

NLDISDSKFLPKREEIVREYFKNINVIK

SEQ ID No. 378:
MRVLALSAVFLVASIIGMPAVAKEWQENKSWNAHFTEHKSQGVVV

LWNENKQQGFTNNLKRANQAFLPASTFKIPNSLIALDLGVVKDEH

-continued
QVFKWDGQTRDIATWNRDHNLITAMKYSVVPVYQEFARQIGEARM

SKMLHAFDYGNEDISGNVDSFWLDGGIRISATEQISFLRKLYHNK

LHVSERSQRIVKQAMLTEANGDYIIRAKTGYSTRIEPKIGWWVGW

VELDDNVWFFAMNMDMPTSDGLGLRQAITKEVLKQEKIIP

SEQ ID No. 379:
MLSRYSKTLAFAVVACTLAISTATAHAELVVRNDLKRVFDDAGVS

GTFVLMDITADRTYVVDPARAARSIHPASTFKIPNSLIAFDTGAV

RDDQEVLPYGGKPQPYEQWEHDMALPEAIRLSAVPIYQEVARRVG

FERMQAYVDAFDYGNRQLGSAIDQFWLRGPLEISAFEEARFTSRM

ALKQLPVKPRTWDMVQRMLLIEQQGDAALYAKTGVATEYQPEIGW

WAGWVERAGHVYAFALNIDMPREGDMAKRIPLGKQLMRALEVWPA

P

SEQ ID No. 380:
MRPLLFSALLLLSGHTQASEWNDSQAVDKLFGAAGVKGTFVLYDV

QRQRYVGHDRERAETRFVPASTYKVANSLIGLSTGAVRSADEVLP

YGGKPQRFKAWEHDMSLRDAIKASNVPVYQELARRIGLERMRANV

SRLGYGNAEIGQVVDNFWLVGPLKISAMEQTRFLLRLAQGELPFP

APVQSTVRAMTLLESGPGWELHGKTGWCFDCTPELGWWVGWVKRN

ERLYGFALNIDMPGGEADIGKRVELGKASLKALGILP

SEQ ID No. 381:
MNKGLHRKRLSKRLLLPMLLCLLAQQTQAVAAEQTKVSDVCSEVT

AEGWQEVRRWDKLFESAGVKGSLLLWDQKRSLGLSNNLSRAAEGF

IPASTFKLPSSLIALETGAVRDETSRFSWDGKVREIAVWNRDQSF

RTAMKYSVVPVYQQLAREIGPKVMAAMVRQLEYGNQDIGGQADSF

WLDGQLRITAFQQVDFLRQLHDNKLPVSERSQRIVKQMMLTEAST

DYIIRAKTGYGVRRTPAIGWWVGWLELDDNTVYFAVNLDLASASQ

LPLRQQLVKQVLKQEQLLP

SEQ ID No. 382:
MNTIISRRWRAGLWRRLVGAVVLPATLAATPAAYAADVPKAALGR

ITERADWGKLFAAEGVKGTIVVLDARTQTYQAYDAARAEKRMSPA

STYKIFNSLLALDSGALDNERAIIPWDGKPRRIKNWNAAMDLRTA

FRVSCLPCYQVVSHKIGRRYAQAKLNEVGYGNRTIGGAPDAYWVD

DSLQISAREQVDFVQRLARGTLPFSARSQDIVRQMSIVEATPDYV

LHGKTGWFVDKKPDIGWWVGWIERDGNITSVAINIDMLSEADAPK

RARIVKAVLKDLKLI

SEQ ID No. 383:
MKTFAAYVITACLSSTALASSITENTFWNKEFSAEAVNGVFVLCK

SSSKSCATNNLARASKEYLPASTFKIPNAIIGLETGVIKNEHQIF

KWDGKPRAMKQWERDLSLRGAIQVSAVPVFQQIAREVGEVRMQKY

LKKFSYGNQNISGGIDKFWLEGQLRISAVNQVEFLESLFLNKLSA

SKENQLIVKEALVTEAAPEYLVHSKTGFSGVGTESNPGVAWWVGW

VEKGAEVYFFAFNMDIDNENKLPLRKSIPTKIMASEGIIGG

SEQ ID No. 384:
MRVLALSAVLVVASIVGMPAMANEWQEKPSWNTHFSEHKAQGVIV
LWNENKQQGFTNNLKRANQAFLPASTFKIPNSLIALDLGVVKDEH
QVFKWDGQTRDIAAWNRDHDLITAMKYSVVPVYQEFARQIGQARM
SKMLHAFDYGNEDISGNLDSFWLDGGIRISATEQVAFLRKLYHNK
LHVSERSQRIVKQAMLTEANSDYIIRAKTGYSTRIEPQIGWWVGW
VELDDNVWFFAMNMDMPTADGLGLRQAITKEVLKQEKIIP

SEQ ID No. 385:
MKKITLFLLFLNLVFGQDKILNNWFKEYNTSGTFVFYDGKTWASN
DFSRAMETFSPASTFKIFNALIALDSGVIKTKKEIFYHRGEKVF
LSSWAQDMNLSSAIKYSNVLAFKEVARRIGIKTMQEYLNKLHYGN
AKISKIDTFWLDNSLKISAKEQAILLFRLSQNSLPFSQEAMNSVK
EMIYLKNMENLELFGKTGFNDGQKIAWIVGFVYLKDENKYKAFAL
NLDIDKFEDLYKREKILEKYLDELVKKVKNDG

SEQ ID No. 386:
MSKKNPILIFIFVILISCKNTEKISNETTLIDNIFTNSNAEGTLV
IYNLNDDKYIIHNKERAEQRFYPASTFKIYNSLIGLNEKAVKDVD
EVFYKLMAKSFLESWAKDSNLRYAIKNSQVPAYKELARRIGIKKM
KENIEKLDFGNKSIGDSVDTFWLEGPLEISAMEQVKLLTKLAQNE
LQYPIEIQKAISDITITRANLHITLHGKTGLADSKNMTTEPIGWF
VGWLEENDNIYVFALNIDNINSDDLAKRINIVKESLKALNLLK

SEQ ID No. 387:
MNKYFTCYVVASLFLSGCTVQHNLINETPSQIVQGHNQVIHQYFD
EKNTSGVLVIQTDKKINLYGNALSRANTEYVPASTFKMLNALIGL
ENQKTDINEIFKWKGEKRSFTAWEKDMTLGEAMKLSAVPVYQELA
RRIGLDLMQKEVKRIGFGNAEIGQQVDNFWLVGPLKVTPIQEVEF
VSQLAHTQLPFSEKVQANVKNMLLLEESNGYKIFGKTGWAMDIKP
QVGWLTGWVEQPDGKIVAFALKMEMRSEMPASIRNELLMKSLKQL
NII

SEQ ID No. 388:
MNIQALLLITSAIFISACSPYIVTANPNYSASKSDEKAEKIKNLF
NEAHTTGVLVIQQGQTQQSYGNDLARASTEYVPASTFKMLNALIG
LEHHKATTTEVFKWDGQKRLFPEWEKNMTLGDAMKASAIPVYQDL
ARRIGLELMSNEVKRIGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGISSSVRKEITYRGLEQ
LGIL

SEQ ID No. 389:
MNIKALLLITSAIFISACSPYIVTANPNHSASKSDEKGEKIKNLF
NEAHTTGVLVIQQGQTQQSYGNDLARASTEYVPASTFKMLNALIG
LEHHKATTTEVFKWDGQKRLFPEWEKDMTLGDAMKASAIPVYQDL
ARRIGLELMSKEVKRVGYGNADIGTQVDNFWLVGPLKITPQQEAQ
FAYKLANKTLPFSPKVQDEVQSMLFIEEKNGNKIYAKSGWGWDVD
PQVGWLTGWVVQPQGNIVAFSLNLEMKKGIPSSVRKEITYKSLEQ
LGIL

SEQ ID No. 390:
MNIKALLLITSAIFISACSPYIVTANPNHSASKSDEKAEKIKNLF
NEAHTTGVLVIQQGQTQQSYGNDLARASTEYVPASTFKMLNALIG
LEHHKATTTEVFKWDGKKRLFPEWEKDMTLGDAMKASAIPVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 391:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAIPVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 392:
MNIKALLLITSAIFISACSPYIVSANPNHSASKSDEKAEKIKNLF
NEAHTTGVLVIQQGQTQQSYGNDLARASTEYVPASTFKMLNALIG
LEHHKATTTEVFKWDGQKRLFPEWEKNMTLGDAMKASAIPVYQDL
ARRIGLELMSNEVKRVGYGNADIGTQVDNFWLVGPLKITPQQEAQ
FAYKLANKTLPFSQEVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 393:
MNIKALLLITSAIFISACSPYIVTANPNHSASKSDDKAEKIKNLF
NEAHTTGVLVIHQGQTQQSYGNDLARASTEYVPASTFKMLNALIG
LEHHKATTTEVFKWDGEKRLFPEWEKNMTLGDAMKASAIPVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 394:
MNIKALLLITSAIFISACSPYIVTANPNHSASKSDKKAEKIKNLF
NEAHTTGVLVIQQGQTQQSYGNDLARASTEYVPASTFKMLNALIG
LEHHKATTTEVFKWNGQKRLFPEWEKDMTLGDAMKASAIPVYQDL
ARRIGLELMSNEVKRVGYGNADIGTQVDNFWLVGPLKITPQQEAQ
FAYKLANKTLPFSQKVQHEVQSMLFIEEKNGNKIYAKSGWGWDVD
PQVGWLTGWVVQPQGNIVAFSLNLEMKKGIPSSVRKEITYKSLEQ
LGIL

SEQ ID No. 395:
MNIKALLLITSAIFISACSPYIVTANPNHSASKSDEKAEKIKNLF
NEAHTTGVLVIQQGQTQQSYGNDLARASTEYVPASTFKMLNALIG
LEHHKTTTTEVFKWDGQKRLFPEWEKDMTLGDAMKASAIPVYQDL
ARRIGLELMSKEVKRVGYGNADIGTQVDNFWLVGPLKITPQQEAQ
FAYKLANKTLPFSPKVQDEVQSMLFIEEKNGNKIYAKSGWGWDVD
PQVGWLTGWVVQPQGNIVAFSLNLEMKKGIPSSVRKEITYKSLEQ
LGIL

SEQ ID No. 396:
MNIKALLLITSAIFISACSPYIVSANPNHSASKSDEKAEKIKNLF
NEAHTTGVLVIQQGQTQQSYGNDLARASTEYVPASTFKMLNALIG
LEHHKATTTAVFKWDGQKRLFPEWEKNMTLGDAMKASAIPVYQDL
ARRIGLELMSNEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGTPSSVRKEITYKSLEQ
LGIL

SEQ ID No. 397:
MNIKALLLITSAIFISACSPYIVSANPNHSASKSDEKAEKIKNLF
NEAHTTGVLVIQQGQTQQSYGNDLARASTEYVPASTFKMLNALIG
LEHHKATTTEVFKWDGQKRLFPEWEKNMTLGDAMKASAIPVYQDL
PRRIGLELMSNEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 398:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAIPVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEK
LGIL

SEQ ID No. 399:
MNIKTLLLITSTIFISACSPYIVTANPNHSTSKSDEKAEKIKNLF
NEAHTTGVLVIQQGQTQQSYGNDLARASIEYVPASTFKMLNALIG
LEHHKATTTEIFKWDGQKRLFPEWEKDMTLGDAMKASAIPVYQDL
ARRIGLELMSKEVKRVGYGNADIGTQVDNFWLVGPLKITPQQEAQ
FAYKLANKTLPFSLKVQDEVQSMLFIEEKNGNKIYAKSGWGWDVD
PQVGWLTGWVVQPQGNIVAFSLNLEMKKGIPSSVRKEITYKSLEQ
LGIL

SEQ ID No. 400:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAISVYQDL
ARRIGLELMSKEVKRVGYGNADIGTQVDNFWLAGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 401:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASALPVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 402:
MNIKALLLITSAIFISACSPYIVTANPNHSASKSDDKAEKIKNLF
NEAHTTGVLVIHQGQTQQSYGNDLARASTEYVPASTFKMLNALIG
LEHHKATTTEVFKWDGEKRLFPEWEKNMTLGDAMKASAIPVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVN
PQVGWLTGSVVQPQGNIVAFSLNLEMKKGIPSSVRKEITYKSLEQ
LGIL

SEQ ID No. 403:
MNIKTLLLITSTIFISACSPYIVTANPNHSTSKSDEKAEKIKNLF
NEAHTTGVLVIQQGQTQQSYGNDLARASIEYVPASTFKMLNALIG
LEHHKATTTEIFKWDGQKRLFPEWEKDMTLGDAMKASAIPVYQDL
ARRIGLELMSKEVKRVGYGNADIGTQVDNFWLVGPLKITPQQEAQ
FAYKLANKTLPFSLKAQDEVQSMLFIEEKNGNKIYAKSGWGWDVD
PQVGWLTGWVVQPQGNIVAFSLNLEMKKGIPSSVRKEITYKSLEQ
LGIL

SEQ ID No. 404:
MNIKALLLITSAIFISACSPYIVTANPNHSASKSDKKAEKIKNLF
NEAHTTGVLVIQQGQTQQSYGNDLARASTEYVPASTFKMLNALIG
LEHHKATTTEVFKWDGKKRLFPEWEKDMTLGDAMKASAIPVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 405:
MNIKTLLLITSAIFISACSHYIVSANPNHSASKSDEKAEKIKNLF
NEAHTTGVLVIQQGQTQQSYGNDLARASTEYVPASTFKMLNALIG
LEHHKATTTEVFKWDGQKRLFPEWEKNMTLGDAMKASAIPVYQDL
ARRIGLELMSNEVKRVGYGNADIGTQVDNFWLVGPLKITPQQEAQ
FTYKLANKTLPFSQKVQDEVQSMLFIEEKNGNKIYAKSGWGWDVN

PQVGWLTGWVVQPQGNIVAFSLNLEMKKGIPSSVRKEITYKSLEQ

LGIL

SEQ ID No. 406:
MNIKALLLITSAIFISACSPYIVSANPNHSASKSDEKAEKIKNLF

NEAHTTGVLVIQQGQTQQSYGNDLARASTEYVPASTFKMLNALIG

LEHHKATTTEVFKWDGQKRLFPEWEKNMTLGDAMKASAIPVYQDL

ARRIGLELMSNEVKRVGYGNADIGTQVDNFWLVGPLKITPQQEAQ

FAYKLANKTLPFSQKVQDEVQSMLFIEEKNGNKIYAKSGWGWDVD

PQVGWLTGWVVQPQGNIVAFSLNLEMKKGIPSSVRKEITYKSLEQ

LGIL

SEQ ID No. 407:
MNIKALLLITSTIFISACSPYIVTANPNHSASKSDEKAEKIKNLF

NEAHTTGVLVIQQGQTQQSYGNDLARASTEYVPASTFKMLNALIS

LEHHKATTTEVFKWDGQKRLFPEWEKDMTLGDAMKASAIPVYQDL

ARRIGLELMSNEVKRVGYGNADIGTQVDNFWLVGPLKITPQQEAQ

FAYKLANKTLPFSQKVQDEVQSMLFIEEKNGNKIYAKSGWGWDVN

PQVGWLTGWVVQPQGNIVAFSLNLEMKKGIPSSVRKEITYKSLEQ

LGIL

SEQ ID No. 408:
MNIQALLLITSAIFISACSPYIVSANPNHSASKSDEKAEKIKNLF

NEAHTTGVLVIQQGQTQQSYGNDLARASTEYVPASTFKMLNALIG

LEHHKATTTEVFKWDGKKRLFPEWEKDMTLGDAMKASAIPVYQDL

ARRIGLELMSKEVKRVGYGNADIGTQVDNFWLVGPLKITPQQEAQ

FAYKLANKTLPFSQKVQDEVQSMLFIEEKNGNKIYAKSGWGWDVN

PQVGWLTGWVVQPHGNIVAFSLNLEMKKGIPSSVRKEITYKSLEQ

LGIL

SEQ ID No. 409:
MNIKALFLITSAIFISACSPYIVTANPNHSASKSDEKAEKIKNLF

NEAHTTGVLVIQQGQTQQSYGNDLARASTEYVPASTFKMLNALIG

LEHHKATTTEVFKWDGKKRLFPEWEKDMTLGDAMKASAIPVYQDL

ARRIGLELMSKEVKRVGYGNADIGTQVDNFWLVGPLKITPQQEAQ

FAYKLANKTLPFSQKVQDEVQSMLFIEEKNGNKIYAKSGWGWDVD

PQVGWLTGWVVQPQGNIVAFSLNLEMKKGIPSSVRKEITYKSLEQ

LGIL

SEQ ID No. 410:
MKLLKILSLVCLSISIGACAEHSMSRAKTSTIPQVNNSIIDQNVQ

ALFNEISADAVFVTYDGQNIKKYGTHLDRAKTAYIPASTFKIANA

LIGLENHKATSTEIFKWDGKPRFFKAWDKDFTLGEAMQASTVPVY

QELARRIGPSLMQSELQRIGYGNMQMGTEVDQFWLKGPLTITPIQ

EVKFVYDLAQGQLPFKPEVQQQVKEMLYVERRGENRLYAKSGWGM

AVDPQVGWYVGFVEKADGQVVAFALNMQMKAGDDIALRKQLSLDV

LDKLGVFHYL

SEQ ID No. 411:
MNIKALLLITSTIFISACSPYIVTANPNHSTSKSDEKAEKIKNLF

NEAHTTGVLVIQQGQTQQSYGNDLARASTEYVPASTFKMLNALIG

LEHHKATTTEIFKWDGQKRLFPEWEKDMTLGDAMKASAIPVYQDL

ARRIGLELMSKEVKRVGYGNADIGTQVDNFWLVGPLKITPQQEAQ

FAYKLANKTLPFSLKVQDEVQSMLFIEEKNGNKIYAKSGWGWDVD

PQVGWLTGWVVQPQGNIVAFSLNLEMKKGIPSSVRKEITYKSLEQ

LGIL

SEQ ID No. 412:
MNIKTLLLITSAIFISACSPYIVTANPNHSASKSDEKAEKIKNLF

NEVHTTGVLVIRQGQTQQSYGNDLARASTEYVPASTFKMLNALIG

LEHHKATTTEVFKWDGQKRLFPEWEKDMTLGDAMKASAIPVYQDL

ARRIGLELMSKEVKRVGYGNADIGTQVDNFWLVGPLKITPQQEAQ

FAYKLANKTLPFSPKVQDEVQSMLFIEEMNGNKIYAKSGWGWDVD

PQVGWLTGWVVQPQGNIVAFSLNLEMKKGIPSSVRKEITYKSLEQ

LGIL

SEQ ID No. 413:
MKLLKILSLVCLSISIGACAEHSMSRAKTSTIPQVNNSIIDQNVQ

ALFNEISGDAVFVTYDGQNIKKYGTHLDRAKTAYIPASTFKIANA

LIGLENHKATSTEIFKWDGKPRFFKAWDKDFTLGEAMQASTVPVY

QELARRIGPSLMQSELQRIGYGNMQIGTEVDQFWLKGPLTITPIQ

EVKFVYDLAQGQLPFKPEVQQQVKEMLYVERRGENRLYAKSGWGM

AVDPQVGWYVGFVEKADGQVVAFALNMQMKAGDDIALRKQLSLDV

LDKLGVFHYL

SEQ ID No. 414:
MKKFILPIFSISILVSLSACSSIKTKSEDNFHISSQQHEKAIKSY

FDEAQTQGVIIIKEGKNLSTYGNALARANKEYVPASTFKMLNALI

GLENHKATTNEIFKWDGKKRTYPMWEKDMTLGEAMALSAVPVYQE

LARRTGLELMQKEVKRVNFGNTNIGTQVDNFWLVGPLKITPVQEV

NFADDLAHNRLPFKLETQEEVKKMLLIKEVNGSKIYAKSGWGMDV

TPQVGWLTGWVEQANGKKIPFSLNLEMKEGMSGSIRNEITYKSLE

NLGII

SEQ ID No. 415:
MAIRIFAILFSIFSLATFAHAQEGTLERSDWRKFFSEFQAKGTIV

VADERQADRAMLVFDPVRSKKRYSPASTFKIPHTLFALDAGAVRD

EFQIFRWDGVNRGFAGHNQDQDLRSAMRNSTVWVYELFAKEIGDD

KARRYLKKIDYGNADPSTSNGDYWIESSLAISAQEQIAFLRKLYR

NELPFRVEHQRLVKDLMIVEAGRNWILRAKTGWEGRMGWWVGVWE

WPTGSVFFALNIDTPNRMDDLFKREAIVRAILRSIEALPPNPAVN

SDAAR

SEQ ID No. 416:
MNIKALLLITSAIFISACSPYIVTANPNHSASKSDEKAEKIKNLF

NEAHTTGVLVIQQGQTQQSYGNDLARASTEYVPASTFKMLNALIG

LEHHKATTTEVFKWDGKKRLFPEWEKNMTLGDAMKASAIPVYQDL

SEQ ID No. 417:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAILVYQDL
ARRIGLELMSKEVKRVGYGNADIGTQVDNFWVVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 418:
MNIKALLLITSAIFISACSPYIVTANPNHSASKSDKKAEKIKNLF
NEAHTTGVLVIQQGQTQQSYGNDLARASTEYVPASTFKMLNALIG
LEHHKATTTEVFKWNGQKRLFPEWEKDMTLGDAMKASAIPVYQDL
ARRIGLELMSNEVKRVGYGNADIGTQVDNFWLVGPLKITPQQEAQ
FAYKLANKTLPFSQKVQDEVQSMLFIEEKNGNKIYAKSGWGWDVD
PQVGWLTGWVVQPQGNIVAFSLNLEMKKGIPSSVRKEITYKSLEQ
LGIL

SEQ ID No. 419:
MNIKALLLITSAIFISACSPYIVTANPNHSASKSDDKAEKIKNLF
NEAHTTGVLVIHQGQTQQSYGNDLARASTEYVPASTFKMLNALIG
LEHHKATTTEVFKWDGEKRLFPEWEKNMTLGDAMKASAIPVYQDL
ARRIGLELMSKEVKRVGYGNADIGTQVDNFWVVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 420:
MNIKALLLITSAIFISACSPYIVTTNPNHSASKSDEKAEKIKNLF
NEAHTTGVLVIQQGQTQQSYGNDLARASTEYVPASTFKMLNALIG
LEHHKATTTEVFKWDGKKRLFPEWEKDMTLGDAMKASAIPVYQDL
ARRIGLELMSKEVKRVGYGNTDIGTQVDNFWVVGPLKITPQQEAQ
FAYKLANKTLPFSQKVQDEVQSMLFIEEKNGNKIYAKSGWGWDVD
PQVGWLTGWVVQPQGNIVAFSLNLEMKKGIPSSVRKEITYKSLEQ
LGIL

SEQ ID No. 421:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAIQVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 422:
MNIKALLLITSAIFISACSPYIVTANPNHSASKSDDKAEKIKNLF
NEAHTTGVLVIHQGQTQQSYGNDLARASTEYVPASTFKMLNALIG
LEHHKATTTEVFKWDGEKRLFPEWEKNMTLGDAMKASALPVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 423:
MNIKTLLLITSAIFISACSPYIVSANPNHSASKSDEKAEKIKNLF
NEAHTTGVLVIQQGQTQQSYGNDLARASTEYVPASTFKMLNALIG
LEHHKATTTEVFKWDGQKRLFPEWEKDMTLGDAMKASAIPVYQDL
ARRIGLELMSKEVKRVGYGNADIGTQVDNFWLVGPLKITPQQEAQ
FAYKLANKTLPFSPKVQDEVQSMLFIEEMNGNKIYAKSGWGWDVD
PQVGWLTGWVVQPQGNIVAFSLNLEMKKGIPSSVRKEITYKSLEQ
LGIL

SEQ ID No. 424:
MNIKALLLITSAIFISACSPYIVTANPNHSASKSDDKAEKIKNLF
NEAHTTGVLVIHQGQTQQSYGNDLARASTEYVPASTFKMLNALIG
LEHHKATTTEVFKWDGEKRLFPEWEKNMTLGDAMKASAIPVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFPLNLEMKKGIPSSVRKEITYKSLEQ
LGIL

SEQ ID No. 425:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAIPVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGGDVN
PQVGWLTGWVVQPQGNIVAFSLNLEMKKGIPSSVRKEITYKSLEQ
LGIL

SEQ ID No. 426:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAILVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 427:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAIPVYQDL
ARRIGLELMSKEVKRVGYGNADIGTQVDNFWVVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 428:
MNIKALLLITSAIFISACSPYIVTANPNHSASKSDEKAEKIKNLF
NEAHTTGVLVIQQGQTQQSYGNDLARASTEYVPASTFKMLNALIG
LEHHKTTTEVFKWDGQKRLFPEWEKDMTLGDAMKASAIPVYQDL
ARRIGLELMSKEVKRVGYGNADIGTQVDNFWVVGPLKITPQQEAQ
FAYKLANKTLPFSPKVQDEVQSMLFIEEKNGNKIYAKSGWGWDVD
PQVGWLTGWVVQPQGNIVAFSLNLEMKKGIPSSVRKEITYKSLEQ
LGIL

SEQ ID No. 429:
MSKKNFILIFIFVILISCKNTEKISNETTLIDNIFTNSNAEGTLV
IYNLNDDKYIIHNKERAEQRFYPASTFKIYNSLIGLNEKAVKDVD
EVFYKYNGEKVFLESWAKDSNLRYAIKNSQVPAYKELARRIGLKK
MKENIEKLDFGNKSIGDSVDTFWLEGPLEISAMEQVKLLTKLAQN
ELPYPIEIQKAVSDITILEQTYNYTLHGKTGLADSKNMTTEPIGW
FVGWLEENDNIYVFALNIDNINSDDLAKRINIVKESLKALNLLK

SEQ ID No. 430:
MSKKNFILIFIFVILTSCKNTEKISNETTLIDNIFTNSNAEGTLV
IYNLNDDKYIIHNKERAEQRFYPASTFKIYNSLIGLNEKAVKDVD
EVFYKYNGEKVFLESWAKDSNLRYAIKNSQVPAYKELARRIGLKK
MKENIEKLDFGNKSIGDSVDTFWLEGPLEISAMEQIKLLTKLAQN
ELPYPIEIQKAVSDITILEQTYNYTLHGKTGLADSKNMTTEPIGW
FVGWLEENDNIYVFALNIDNINSDDLAKRINIVKESLKALNLLK

SEQ ID No. 431:
LLITSAIFISACSPYIVSANPNHSASKSDDKAEKIKNLFNEAHTT
GVLVIQQGQTQQSYGNDLARASTEYVPASTFKMLNALIGLEHHKA
TTTEVFKWDGQKRLFPEWEKNMTLGDAMKASAIPVYQDLARRIGL
ELMSNEVKRVGYGNADIGTQVDNFWLVGPLKITPQQEAQFAYKLA
NKTLPFSQKVQDEVQSMLFIEEKNGNKIYAKSGWGWDVDPQVGWL
TGWVVQPQGNIVAFSLNLEMKKGIPSSVRKEITYKSL

SEQ ID No. 432:
LLITSAIFISACSPYIVSANPNHSASKSDEKAEKIKNLFNEAHTT
GVLVIQQGQTQQSYGNDLARASTEYVPASTFKMLNALIGLEHHKA
TTTEVFKWDGQKRLFPEWEKNMTLGDAMKASAIPVYQDLARRIGL
ELMSNEVKRVGYGNADIGTQVDNFWLVGPLKITPQQEAQFAYKLA
NKTLPFSQKVQDEVQSMLFIEEKNGNKIYAKSGWGWDVNPQVGWL
TEWVVQPQGNIVAFSLNLEMKKGIPSSVRKEITYKSL

SEQ ID No. 433:
MTVRRLSCALGAALSLSALGGGPVQAAVLCTVVADAADGRILFQQ
GTQQACAERYTPASTFKLAIALMGADAGILQGPHEPVWNYQPAYP
DWGGDAWRQPTDPARWIKYSVVWYSQLTAKALGQDRFQRYTSAFG
YGNADVSGEPGKHNGTDGAWIISSLRISPLEQLAFLRKLVNRQLP
VKAAAYELAENLFEAGQADGWRLYGKTGTGSPGSNGVYTAANAYG
WFVGWARKDGRQLVYARLLQDERATRPNAGLRARDELVRDWPAMA
GAWRP

SEQ ID No. 434:
MNIKALLLITSAIFISACSPYIVSANPNHSASKSDEKAEKIKNLF
NEAHTTGVLVIQQGQTQQSYGNVLARASTEYVPASTFKMLNALIG
LEHHKATTTEVFKWDGQKRLFPEWEKNMTLGDAMKASAIPVYQDL
ARRIGLELMSNEVKRVGYGNADIGTQVDNFWLVGPLKITPQQEAQ
FAYKLANKTLPFSQEVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 435:
MKTFAAYVIIACLSSTALAGSITENTSWNKEFSAEAVNGVFVLCK
SSSKSCATNDLARASKEYLPASTFKIPSAIIGLETGVIKNEHQVF
KWDGKPRAMKQWERDLTLRGAIQVSAVPVFQQIAREVGEVRMQKY
LKKFSYGNQNISGGIDKFWLEDQLRISAVNQVEFLESLYLNKLSA
SKENQLIVKEALVTEAAPEYLVHSKTGFSGVGTESNPGVAWWVGW
VEKETEVYFFAFNMDIDNESKLPLRKSIPTKIMESEGIIGG

SEQ ID No. 436:
MNIKTLLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAIPVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 437:
MNIKALLLITSAIFISACSPYIVTTNPNHSASKSDEKAEKIKNLF
NEAHTTGVLVIQQGQTQQSYGNDLARASTEYVPASTFKMLNALIG
LEHHKATTTEVFKWDGKKRLFPEWEKDMTLGDAMKASAIPVYQDL
ARRIGLELMSKEVKRVGYGNTDIGTQVDNFWLVGPLKITPQQEAQ
FAYKLANKTLPFSQKVQDEVQSMLFIEEKNGNKIYAKSGWGWDVD
PQVGWLTGWVVQPQGNIVAFSLNLEMKKGIPSSVRKEITYKSLEQ
LGIL

SEQ ID No. 438:
MNIKALLLITSAIFISACSPYIVTANPNHSASKSDVKAEKIKNLF
NEAHTTGVLVIQQGQTQQSYGNDLARASTEYVPASTFKMLNALIG

LEHHKATTTEVFKWDGKKRLFPEWEKDMTLGDAMKASAVPVYQDL

ARRIGLELMSKEVKRVGYGNADIGTQVDNFWLVGPLKITPQQEAQ

FAYKLANKTLPFSQKVQDEVQSMLFIEEKNGNKIYAKSGWGWDVN

QQVGWLTGWVVQPQGNIVAFSLNLEMKKGIPSSVRKEITYKSLEQ

LGIL

SEQ ID No. 439:
MNIKTLLLITSAIFISACSPYIVTANPNHSASKSDEKAEKIKNLF

NEVHTTGVLVIQQGQTQQSYGNDLARASTEYVPASTFKMLNALIG

LENHKATTTEVFKWDGQKRLFPEWEKDMTLGDAMKASAIPVYQDL

ARRIGLELMSKEVKRVGYGNADIGTQVDNFWLVGPLKITPQQEAQ

FAYKLANKTLPFSPKVQDEVQSMLFIEEKNGNKIYAKSGWGWDVD

PQVGWLTGWVVQPQGNIVAFSLNLEMKKGIPSSVRKEMTYKSLEQ

LGIL

SEQ ID No. 440:
MNKYFTCYVVASLFFSGCTVQHNLINETQSQIVQGHNQVIHQYFD

EKNTSGVLVIQTDKKINLYGNALSRANTEYVPASTFKMLNALIGL

ENQKTDINEIFKWKGEKRSFTTWEKDMTLGEAMKLSAVPVYQELA

RRIGLDLMQKEVERIDFGNAEIGQQVDNFWLIGPLKVTPIQEVEF

VSQLAHTQLPFSEKVQANVKNMLLLEENNGYKIFGKTGWAMDIKP

QVGWLTGWVEQPDGKIVAFALNMEMRSEMPASIRNELLMKSLKQL

NII

SEQ ID No. 441:
MNKYFTCYVVASLFLSGCTVQHNLINETPSQIVQGHNQVIHQYFD

EKNTSGVLVIQTDKKINLYGNALSRANTEYVPASTFKMLNALIGL

ENQKTDINEIFKWKGEKRSFTAWEKDMTLGEAMKLSAVPVYQELA

RRIGLDLMQKEVKRIGFGNAEIGQQVDNFWLVGPLKVTPIQEVEF

VSQLAHTQLPFSEKVQANVKNMLLLEESNGYKIFGKTGWAAMDIK

PQVGWLTGWVEQPDGKIVAFALNMEMRSEMPASIRNELLMKSLKQ

LNII

SEQ ID No. 442:
MKTFAAYVITACLSSTALASSITENTSWNKEFSAEAVNGVFVLCK

SSSKSCATNNLARASKEYLPASTFKIPNAIIGLETGVIKNEHQVF

KWDGKPRAMKQWERDLSLRGAIQVSAVPVFQQIAREVGEVRMQKY

LKKFSYGNQNISGGIDKFLLEGQLRISAVNQVEFLESLFLNKLSA

SKENQLIVKEALVTEAAPEYLVHSKTGFSGVGTESNPGVAWWVGW

VEKGTEVYFFAFNMDIDNENKLPLRKSIPTKIMASEGIIGG

SEQ ID No. 443:
MAIRIFAILFSIFSLATFAHAQEGTLERSDWRKFFSEFQAKGTIV

VADERQADRAMLVFDPVRSKKRYSPASTFKIPHTLFALDAGAVRD

EFQIFRWDGVNRGFAGHNQDQDLRSAMRNSTVWVYELFAKEIGDD

KARRYLKKIDYGDADPSTSNGDYWIEGSLAISAQEQIAFLRKLYR

NELPFRVEHQRLVKDLMIVEAGRNWILRAKTGWEGRMGWWVGWVE

WPTGSVFFALNIDTPNRMDDLFKREAIVRAILRSIEALPPNPAVN

SDAAR

SEQ ID No. 444:
MNIKALLLITSAIFISACSPYIVTANPNHSASKSDKKAEKIKNLF

NEAHTTGVLVIQQGQTQQSYGNDLARASTEYVPASTFKMLNALIG

LEHHKASTTEVFKWNGQKRLFPEWEKDMTLGDAMKASAIPVYQDL

ARRIGLELMSNEVKRVGYGNADIGTQVDNFWLVGPLKITPQQEAQ

FAYKLANKTLPFSQKVQDEVKSMLFIEEKNGNKIYAKSGWGWDVD

PQVGWLTGWVVQPQGNIVAFSLNLEMKKGIPSSVRKEITYKSLEQ

LGIL

SEQ ID No. 445:
MNIKALLLITSAIFISACSPYIVSANPNHSASKSDEKAEKIKNLF

NEAHTTGVLVIQQGQTQQSYGNDLARASTEYVPASTFKMLNALIG

LEHHKATTTEVFKWDGQKRLFPEWEKNMTLGDAMKASAIPVYQDL

ARRIGLELMSNEVKHVGYGNADIGTQVDNFWLVGPLKITPQQEAQ

FAYKLANKTLPFSPKVQDEVQSMLFIEEKNGNKIYAKSGWGWDVN

PQVGWLTGWVVQPQGNIVAFSLNLEMKKGIPSSVRKEITYKSLEQ

LGIL

SEQ ID No. 446:
MNIKALLLITSAIFISACSPYIVSANPNHSASKSDEKAEKIKNLF

NEAHTTGVLVIQQGQTQQSYGNDLARASTEYVPASTFKMLNALIG

LEHHKATTTEVFKWDGQKRLFPEWEKNMTLGDAMKASAIPVYQDL

ARRIGLELMSNEVKHVGYGNADIGTQVDNFWLVGPLKITPQQEAQ

FAYKLANKTLPFSQKVQDEVQSMLFIEEKNGNKIYAKSGWGWDVN

PQVGWLTGWVVQPQGNIVAFSLNLEMKKGIPSSVRKEITYKSLEQ

LGIL

SEQ ID No. 447:
MKKFILPILSISTLLSVSACSSIQTKFEDTFHTSNQQHEKAIKSY

FDEAQTQGVIIIKKGKNISTYGNNLTRAHTEYVPASTFKMLNALI

GLENHKATTTEIFKWDGKKRSYPMWEKDMTLGDAMALSAVPVYQE

LARRTGLDLMQKEVKRVGFGNMNIGTQVDNFWLVGPLKITPIQEV

NFADDFANNRLPFKLETQEEVKKMLLIKEFNGSKIYAKSGWGMDV

TPQVGWLTGWVEKSNGEKVAFSLNIEMKQGMPGSIRNEITYKSLE

NLGII

SEQ ID No. 448:
MNIKALLLITSAIFISACSPYIVSANPNHSASKSDEKAEKIKNLF

NEAHTTGVLVIQQGQTQQSYGNDLARASTEYVPASTFKMLNALIG

LEHHKATTEVFKWDGQKRLFPEWEKNMTLGDAMKASAIPVYQDL

ARRIGLELMSNEVKRVGYGNADIGTQVDNFWLVGPLKITPQQEAQ

FAYKLANKTLPFSQEVQDEVQSILFIEEKNGNKIYAKSGWGWDVN

PQVGWLTGWVVQPQGNIVAFSLNLEMKKGIPSSVRKEITYKSLEQ

LGIL

SEQ ID No. 449:
MKKFILPIFSISILVSLSACSSIKTKSEDNFHISSQQHEKAIKSY
FDEAQTQGVIIIKEGKNLSTYGNALARANKEYVPASTFKMLNALI
GLENHKATTNEIFKWDGKKRTYPMWEKDMTLGEAMALSAVPVYQE
LARRTGLELMQKEVKRVNFGNTNIGTQVDNFWLVGPLKITPVQEV
NFADDLAHNRLPFKLETQEEVKKMLLIKEVNGSKIYAKSGWGMGV
TSQVGWLTGWVEQANGKKIPFSLNLEMKEGMSGSIRNEITYKSLE
NLGII

SEQ ID No. 450:
MRVLALSAVFLVASIIGMPAVAKEWQENKSWNAHFTEHKSQGVVV
LWNENKQQGFTNNLKRANQAFLPASTFKIPNSLIALDLGVVKDEH
QVFKWDGQTRDIATWNRDHNLITAMKYSVVPVYQEFARQIGEARM
SKMLHAFDYGNEDISGNVDSFWLDGGIRISATEQISFLRKLYHNK
LHVSERSQRIVKQAMLTEANGDYIIRAKTGYSARIEPKIGWWVGW
VELDDNVWFFAMNMDMPTSDGLGLRQAITKEVLKQEKIIP

SEQ ID No. 451:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAVPVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGLDVN
PQVGWLTGWVVQPQGNIVAFSLNLEMKKGIPSSVRKEITYKSLEQ
LGIL

SEQ ID No. 452:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAVPVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGLDVN
LQVGWLTGWVVQPQGNIVAFSLNLEMKKGIPSSVRKEITYKSLEQ
LGIL

SEQ ID No. 453:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAIPVYQDL
ARRIGLELMSKEVKRVGYGNADIGTQVDNFWVVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEK
LGIL

SEQ ID No. 454:
MNIKALLLITSAIFISACSPYIVTANPNHSASKSDVKAEKIRNLF
NEAHTTGVLVIQQGQTQQSYGNDLARASTEYVPASTFKMLNALIG
LEHHKATTTEVFKWDGKKRLFPEWEKDMTLGDAMKASAIPVYQDL
ARRIGLELMSKEVKRVGYGNADIGTQVDNFWVVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 455:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDSKKRLFPEWEKDMTLGDAMKASAIPVYQDL
ARRIGLELMSKEVKRVGYGNADIGTQVDNFWVVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 456:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAIPVYQDL
ARRIGLELMSKEVKRVGYGNADIGTQVDNFWVVGPLKITPQQEAQ
FAYKLANKTLPFSQKVQDGVQSMLFIEEKNGNKIYAKSGWGWDVN
PQVGWLTGWVVQPQGNIVAFSLNLEMKKGIPSSVRKEITYKSLEQ
LGIL

SEQ ID No. 457:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDSKKRLFPEWEKDMTLGDAMKASAILVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 458:
MKLLKILSLVOLSISIGACAEHSMSRAKTSTIPQVNNSIIDQNVQ
ALFNEISADAVFVTYDGQNIKKYGTHLDRAKTAYIPASTFKIANA
LIGLENHKATSTEIFKWDGKPRFLKAWDKDFTLGEAMQASTVPVY
QELARRIGPSLMQSELQRIGYGNMQIGTEVDQFWLKGPLTITPIQ
EVKFVYDLAQGQLPFKPEVQQQVKEMLYVERRGENRLYAKSGWGM
AVDPQVGWYVGFVEKADGQVVAFALNMQMKAGDDIALRKQLSLDV
LDKLGVFHYL

SEQ ID No. 459:
MNKYFTCYVVASLFLSGCTVQHNLINETPSQIVQGHNQVIHQYFD
EKNTSGVLVIQTDKKINLYGNALSRANTEYVPASTFKMLNALIGL
ENQKTDINEIFKWKGEKRSFTAWEKDMTLGEAMKLSAVPVYQELA
RRIGLDLMQKEVKRIGFGNAEIGQQVDNFWLVGPLKVTPIQEVEF
VSQLAHTQLPFSEKVQANVKNMLLLEESNGYKIFGKTGWAMDVKP
QVGWLTGWVEQPDGKIVAFALNMEMRSEMPASIRNELLMKSLKQL
NII

SEQ ID No. 460:
MNKYFTCYVVASLFLSGCTVQHNLINETPSQIVQGHNQVIHQYFD
EKNTSGALVIQTDKKINLYGNALSRANTEYVPASTFKMLNALIGL
ENQKTDINEIFKWKGEKRSFTAWEKDMTLGEAMKLSAVPVYQELA
RRIGLDLMQKEVKRIGFGNAEIGQQVDNFWLVGPLKVTPIQEVEF
VSQLAHTQLPFSEKVQANVKNMLLEESNGYKIFGKTGWAMDIKP
QVGWLTGWVEQPDGKIVAFALNMEMRSEMPASIRNELLMKSLKQL
NII

SEQ ID No. 461:
MNKYFTCYVVASLFLSGCTVQHNLINETPSQIVQGHNQVIHQYFD
EKNTSGVLVIQTDKKINLYGNALSRANTEYVPASTFKMLNALIGL
ENQKTDINEIFKWKGEKRSFTAWEKDMTLGEAMKLSAVPVYQELA
RRIGLDLMQKEVKRIGFGNAEIGQQVDNFWLVGPLKVTPIQEVEF
VSQLAHTQLPFSEKVQANVKNMLLEESNGYKIFGKTGWAMDIKP
QVGWLTGWVEQPDGKIVAFALNMEMRSEMPASIRNELMMKSLKQL
NII

SEQ ID No. 462:
MNKYFTCYVVASLFLSGCTVQHNLINETPSQIVQGHNQVIHQYFD
EKNTSGVLVIQTDKKINLYGNALSRANTEYVPASTFKMLNALIGL
ENQKTDINEIFKWKGEKRSFTAWEKDMTLGEAMKLSAVPVYQELA
RRIGLDLMQKEVKRIGFGNAEIGQQVDNFWLVGPLKVTPIQEVEF
VSQLAHTQLPFSEKVQANVKNMLLEESNGYKIFGKTGWAMDIKP
QVGWLAGWVEQPDGKIVAFALNMEMRSEMPASIRNELLMKSLKQL
NII

SEQ ID No. 463:
MNKYFTCYVVASLFLSGCTVQHNLINETPSQIVQGHNQVIHQYFD
ERNTSGVLVIQTDKKINLYGNALSRANTEYVPASTFKMLNALIGL
ENQKTDINEIFKWKGEKRSFTAWEKDMTLGEAMKLSAVPVYQELA
RRIGLDLMQKEVKRIGFGNAEIGQQVDNFWLVGPLKVTPIQEVEF
VSQLAHTQLPFSEKVQANVKNMLLEESNGYKIFGKTGWAMDIKP
QVGWLTGWVEQPDGKIVAFALNMEMRSEMPASIRNELLMKSLKQL
NII

SEQ ID No. 464:
MNKYFTCYVVASLFLSGCTVQHNLINETPSQIVQGHNQVIHQYFD
EKNTSGVLVIQTDKKINLYGNALSRANTEYVPASTFKMLNALIGL
ENQKTDINEIFKWKGEKRSFTAWEKDMTLGEAMKLSAVPVYQELA
RRIGLDLMQKEVKRIGFGNAEIGQQVDNFWLVGPLKVTPIQEVEF
VSQLAHTQLPFSEKVQANVKNMLLEKSNGYKIFGKTGWAMDIKP
QVGWLTGWVEQPDGKIVAFALNMEMRSEMPASIRNELLMKSLKQL
NII

SEQ ID No. 465:
MNKYFTCYVVASLFLSGCTVQHNLINETPSQIVQGHNQVIHQYFD
EKNTSGVLVIQTDKKINLYGNALSRANTEYVPASTFKMLNALIGL
ENQKTDINEIFKWKGEKRSFTAWEKDMTLGEAMKLSAVPVYQELA
RRIGLDLMQKEVKRIGFGNAEIGQQVDNFWLVGPLKVTPIQEVEF
VSQLAHTQLPFSEKVQANVKNMLLLEESNGYKIFGKTGWAMDIKP
QVGWLTGWVEQPDGKIVAFALNMEMRSEMPASTRNELLMKSLKQL
NII

SEQ ID No. 466:
MKKFILPIFSISILLSLSACSSIQTKFEDTFHISNQKHEKAIKSY
FDEAQTQGVIIIKEGKNISSYGNNLVRAHTEYVPASTFKMLNALI
GLENHKATTNEIFKWDGKKRSYPMWEKDMTLGEAMALSAVPVYQD
LARRIGLNLMQKEVKRVGFGNMNIGTQVDNFWLIGPLKITPIQEV
NFADDLANNRLPFKLETQEEVKKMLLIKEVNGSKIYAKSGWGMDV
SPQVGWLTGWVEKSNGEKVSFSLNIEMKQGMSGSIRNEITYKSLE
NLGII

SEQ ID No. 467:
MNIKALLLITSAIFISACSPYIVTANPNHSASKSDEKAEKIKNLF
NEAHTTGVLVIQQGQTQQSYGNDLARASTEYVPASTFKMLNALIG
LEHHKATTTEVFKWDGQKRLFPEWEKDMTLGDAMKASAIAVYQDL
ARRIGLELMSKEVKRVGYGNADIGTQVDNFWLVGPLKITPQQEAQ
FAYKLANKTLPFSPKVQDEVQSMLFIEEKNGNKIYAKSGWGWDVD
PQVGWLTGWVVQPQGNIVAFSLNLEMKKGIPSSVRKEITYKSLEQ
LGIL

SEQ ID No. 468:
MNIKALLLITSAIFISACSPYIVTANPNHSASKSDEKAEKIKNLF
NEAHTTGVLVIQQGQTQQSYGNDLARASTEYVPASTFKMLNALIG
LEHHKATTTEVFKWDGQKRLFPEWEKDMTLGDAIKASAIPVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVD
PQVGWLTGWVVQPQGNIVAFSLNLEMKKGIPSSVRKEITYKSLEQ
LGIL

SEQ ID No. 469:
MKILIFLPLLSCLGLTACSLPVSSLPSQSISTQAIASLFDQAQSS
GVLVIQRDQQVQVYGNDLNRANTEYVPASTFKMLNALIGLQHGKA
TTNEIFKWDGKKRSFTAWEKDMTLGQAMQASAVPVYQELARRIGL
ELMQQEVQRIQFGNQQIGQQVDNFWLVGPLKVTPKQEVQFVSALA
REQLAFDPQVQQQVKAMLFLQERKAYRLYVKSGWGMDVEPQVGWL
TGWVETPQAEIVAFSLNMQMQNGIDPAIRLEILQQALAELGLYPK
AEG

SEQ ID No. 470:
MHKHMSKLFIAFLAFLLSVPAAAEDQTLAELFAQQGIDGTIVISS
LHNGKTFIHNDPRAKQRFSTASTFKILNTLISLEEKAISGKDDVL
KWDGHIYDFPDWNRDQTLESAFKVSCVWCYQALARQVGAEKYRNY
LRKSVYGELREPFEETTFWLDGSLQISAIEQVNFLKKVHLRTLPF

SASSYETLRQIMLIEQTPAFTLRAKTGWATRVKPQVGWYVGHVET
PTDVWFFATNIEVRDEKDLPLRQKLTRKALQAKGIIE

SEQ ID No. 471:
MKTFAAYVITACLSSTALASSITENTSWNKEFSAEAVNGVFVLCK
SSSKSCATNNLARASKEYLPASTFKIPNAIIGLETGVIKNEHQVF
KWDGKPRAMKQWERDLSLRGAIQVSAVPVFQQIAREVGEVRMQKY
LKKFSYGNQNISGGTDKFWLEDQLRISAVNQVEFLESLFLNKLSS
KENQLIVKEALVTEAAPEYLVHSKTGFSGVGTESNPGVAWWVGWV
EKGTEVYFFAFNMDIDNENKLPLRKSIPTKIMASEGIIGG

SEQ ID No. 472:
MNIKALLLITSAIFISACSPYIVTANPNHSASKSDEKAEKIKNLF
NEAHTTGVLVIQQGQTQQSYGNDLARASTEYVPASTFKMLNALIG
LEHHKATTTEVFKWDGKKRLFPEWEKDMTLGDAMKASAILVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGLDVD
PQVGWLTGWVVQPQGNIVAFSLNLEMKKGIPSSVRKEITYKSLEQ
LGIL

SEQ ID No. 473:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAIQVYQDL
ARRIGLELMSKEVKRVGYGNADIGTQVDNFWVVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 474:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAMPVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 475:
MNIKALLLITSAIFISACSPYIVTANPNHSASKSDEKAEKIKNLF
NEVHTTGVLVIQQGQTQQSYGNDLARASTEYVPASTFKMLNALIG
LEHHKATTTEVFKWDGKKRLFPEWEKNMTLGDAMKASAIPVYQDL
ARRIGLELMSNEVKRVGYGNADIGTQVDNFWLVGPLKITPQQEAQ
FAYKLANKTLPFSQKVQDEVQSMLFIEEKNGNKIYAKSGWGWDVD
PQVGWLTGWVVQPQGNIVAFSLNLEMKKGIPSSVRKEITYKSLEQ
LGIL

SEQ ID No. 476:
MRVLALSAVFLVASIIGMPAVAKEWQENKSWNAHFTEHKSQGVVV
LWNENKQQGFTNNLKRANQAFLPASTFKIPNSLIALDLGVVKDEH
QVFKWDGQTRDIATWNRDHNLITAMKYSWPVYQEFARQIGEARMS
KMLHAFDYGNEDISGNVDSFWLDGGIRISATEQISFLRKLYHNKL
HVSERSQRIVKQAMLTEANGDYIIRAKTGYDTKIGWWVGWVELDD
NVWFFAMNMDMPTSDGLGLRQAITKEVLKQEKIIP

SEQ ID No. 477:
MSKKNFILIFIFVILISCKNTEKTSNETTLIDNIFTNSNAEGTLV
IYNLNDDKYIIHNKERAEQRFYPASTFKIYNSLIGLNEKAVKDVD
EVFYKYNGEKVFLESWAKDSNLRYAIKNSQVPAYKELARRIGLEK
MKENIEKLDFGNKNIGDSVDTFWLEGPLEISAMEQVKLLTKLAQN
ELPYPIEIQKAVSDITILEQTDNYTLHGKTGLADSENMTTEPIGW
LVGWLEENNNIYVFALNIDNINSDDLAKRINIVKESLKALNLLK

SEQ ID No. 478:
MNIKALFLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAIPVYQDL
ARRIGLELMSKEVKRVGYGNADIGTQVDNFWVVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 479:
MNIKALFLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAIPVYQDL
ARRIGLELMSKEVKRVGYGNADIGTQVDNFWVVGPLKITPQQEAQ
FAYKLANKTLPSSQKVQDEVQSMLFIEEKNGNKMYAKSGWGWDVN
PQVGWLTGWVVQPQGNIVAFSLNLEMKKGIPSSVRKEITYKSLEQ
LGIL

SEQ ID No. 480:
MNIKALFLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAIPVYQDL
ARRIGLELMSKEVKRVGYGNADIGTQVDNFWVVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEIAYKSLEQ
LGIL

SEQ ID No. 481:
MAIRIFAILFSIFSLATFAHAQEGTLERSDWRKFFSEFQAKGTIV
VADERQADRAMLVFDPVRSKKRYSPASTFKIPHTLFALDAGAVRD
EFQIFRWDGVNRGFAGHNQDQDLRSAMRNSTVWVYELFAKEIGDD
KARRYLKKIDYGNADPSTSNGDCWIEGSLAISAQEQIAFLRKLYR
NELPFRVEHQRLVKDLMIVEAGRNWILRAKTGWEGRMGWWVGWVE
WPTGSVFFALNIDTPNRMDDLFKREAIVRAILRSIEALPPNPAVN
SDAAR

SEQ ID No. 482:
MNIKTLLLITSAIFISACSPYIVTANPNHSASKSDEKAEKIKNLF
NEVHTTGVLVIQQGQTQQSYGNDLARASTEYVPASTFKMLNALIG
LEHHKATTTEVFKWDGQKRLFPEWEKDMTLGDAMKASAIPVYQDL
ARRIGLELMSKEVKRVGYGNADIGTQVDNFWVVGPLKITPQQEAQ
FAYKLANKTLPFSPKVQDEVQSMLFIEEKNGNKIYAKSGWGWDVD
PQVGWLTGWVVQPQGNIVAFSLNLEMKKGIPSSVRKEITYKSLEQ
LGIL

SEQ ID No. 483:
MNIKTLLLITSAIFISACSPYIVTANPNHSASKSDEKAEKIKNLF
NEVHTTGVLVIQQGQTQQSYGNDLARASTEYVPASTFKMLNALIG
LEYHKATTTEVFKWDGQKRLFPEWEKDMTLGDAMKASAIPVYQDL
ARRIGLELMSKEVKRVGYGNADIGTQVDNFWLVGPLKITPQQEAQ
FAYKLANKTLPFSPKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 484:
MAIRFLTILLSTFFLTSFVHAQEHVVVRSDWKKFFSDLQAEGAIV
IADERQAEHALLVFGQERAAKRYSPASTFKLPHTLFALDAGAVRD
EFQVFRWDGVKRSFAGHNQDQDLRSAMRNSAVWVYELFAKEIGED
NARRYLKQIDYGNADPSTIKGNYWIDGNLEISAHEQISFLRKLYR
NQLPFQVEHQRLVKYLMITEAGRNWILRAKTGWEGRFGWWIGWVE
WPTGPVFFALNIDTPNRTDDLFKREAIARAILRSIDALPPN

SEQ ID No. 485:
MRVLALSAVFLVASIIGMPAVAKEWQENKSWNAHFTEHKSQGVVV
LWNENKQQGFTNNLKRANQAFLPASTFKIPNSLIALDLGVVKDEH
QVFKWDGQTRDIAAWNRDHDLITAMKYSVVPVYQEFARQIGEARM
SKMLHAFDYGNEDISGNVDSFWLDGGIRISATQQIAFLRKLYHNK
LHVSERSQRIVKQAMLTEANGDYIIRAKTGYSTRIEPKIGWWVGW
VELDDNVWFFAMNMDMPTSDGLGLRQAITKEVLKQEKIIP

SEQ ID No. 486:
MNKYFTCYVVASLFLSGCTVQHNLINETPSQIVQGHNQVIHQYFD
EKNTSGVLVIQTDKKINLYGNALSRANTEYVPASTFKMLNALIGL
ENQKTDINEIFKWKGEKRSFTAWEKDMTLGEAMKLSAVPVYQELA
RRIGLDLMQKEVKRIGFGNAEIGQQVDNFWLVGPLKVTPIQEVEF
VSQLAHTQLPFSEKVQANVKNMLLLEESNGYKIFGKTGWAMDIKS
QVGWLTGWVEQPDGKIVAFALNMEMRSEMPASIRNELLMKSLKQL
NII

SEQ ID No. 487:
MNIKALLLITSAIFISACSPYIVTANPNHSASKSDVKAEKIKNLF
NEAHTTGVLVIQQGQTQQSYGNDLARASTEYVPASTFKMLNALIG
LEHHKATTTEVFKWDGKKRLFPEWEKDMTLGDAMKASAISVYQDL
ARRIGLELMSKEVKRVGYGNADIGTQVDNFWLVGPLKITPQQEAQ
FAYKLANKTLPFSQKVQDEVQSMLFIEEKNGNKIYAKSGWGWDVN
PQVGWLTGWVVQPQGNIVAFSLNLEMKKGIPSSVRKEITYKSLEQ
LGIL

SEQ ID No. 488:
MAIRIFAILFSIFSLATFAHAQEGTLERSDWRKFFSEFQAKGTIV
VADERQADRAMLVFDPVRSKKRYSPASTFKIPHTLFALDAGAVRD
EFQIFRWDGVNRGFAGHNQDQDLRSAMRNSTVWVYELFAKEIGDD
KARRYLKKIDYGNADPSTSNGDYWIEGSLAISAQEQIAFLRKLYR
NELPFRVEHQRLVKDLMIVEAGRNWILRAKTGWEGRMGWWVGWVE
WPTGSVFFALNIDTPNRMDDLFKREAIVRAILRSIEALPPNPAVN
SDAAR

SEQ ID No. 489:
MKTIAAYLVLVFYASTALSESISENLAWNKEFSSESVHGVFVLCK
SSSNSCTTNNAARASTAYIPASTFKIPNALIGLETGAIKDERQVF
KWDGKPRAMKQWEKDLKLRGAIQVSAVPVFQQIAREVGEIRMQKY
LNLFSYGNANIGGGIDKFWLEGQLRISAFNQVKFLESLYLNNLPA
SKANQLIVKEAIVTEATPEYIVHSKTGYSGVGTESSPGVAWWVGW
VEKGTEVYFFAFNMDIDNESKLPSRKSISTKIMASEGIIGG

SEQ ID No. 490:
MKTFAAYVITACLSSTALASSITENTFWNKEFSAEAVNGVFVLCK
SSSKLACATNNLARASKEYLPASTFKIPNAIIGLETGVIKNEHQI
FKWDGKPRAMKQWERDLSLRGAIQVSAVPVFQQIAREVGEVRMQK
YLKKFSYGNQNISGGIDKFWLEGQLRISAVNQVEFLESLFLNKLS
ASKENQLIVKEALVTEAPEYLVHSKTGFSGVGTESNPGVAWWVGW
VEKGAEVYFFAFNMDIDNENKLPLRKSIPTKIMASEGIIGG

SEQ ID No. 491:
MAIRIFAILFSTFVFGTFAHAQEGMRERSDWRKFFSEFQAKGTIV
VADERQTDRVILVFDQVRSEKRYSPASTFKIPHTLFALDAGAARD
EFQVFRWDGIKRSFAAHNQDQDLRSAMRNSTVWIYELFAKEIGED
KARRYLKQIDYGNADPSTSNGDYWIDGNLAIAAQEQIAFLRKLYH
NELPFRVEHQRLVKDLMIVEAGRNWILRAKTGWEGRMGWWVGWVE
WPTGPVFFALNIDTPNRMDDLFKREAIVRAILRSIEALPPNPAVN
SDAAR

SEQ ID No. 492:
MKTFAAYVIIACLSSTALAGSITENTSWNKEFSAEAVNGVFVLCK
SSSKSCATNDLARASKEYLPASTFKIPNAIIGLETGVIKNEHQVF
KWDGKPRAMKQWERDLTLRGAIQVSAVPVFQQIAREVGEVRMQKY
LKKFSYGSQNISGGIDKFWLEDQLRISAVNQVEFLESLYLNKLSA
SKENQLIVKEALVTEAAPEYLVHSKTGFSGVGTESNPGVAWWVGW
VEKETEVYFFAFNMDIDNESKLPLRKSIPTKIMESEGIIGG

SEQ ID No. 493
MNKYFTCYVVASLFLSGCTVQHNLINETPSQIVQGHNQVIHQYFD
EKNTSGVLVIQTDKKINLYGNALSRANTEYVPASTFKMLNALIGL
ENQKTDINEIFKWKGEKRSFTAWEKDMTLGEAMKLSAVPVYQELA

```
RRIGLDLMQKEVKRIGFGNAEIGQQVDNFWLVGPLKVTPIQEVEF

VSQLAHTQLPFSEKVQANVKNMLLLEESNGYKIFGKTGWAMDIKP

QVGWLTGWVEQPDGKIVAFALNMEMRSEMPASIRNELLMKSLKQL

NII

SEQ ID No. 494
MKKLSVLLWLTLFYCGTIWAQSTCFLVQENQTVLKHEGKDCNKRF

APESTFKIALSLMGFDSGILKDTLNPEWPYKKEYELYLNVWKYPH

NPRTWIRDSCVWYSQVLTQQLGMTRFKNYVDAFHYGNQDISGDKG

QNNGLTHSWLSSSLAISPSEQIQFLQKIVNKKLSVNPKAFTMTKD

ILYIQELAGGWKLYGKTGNGRQLTKDKSQKLSLQHGWFIGWIEKD

GRVITFTKHIADSKKHVTFASFRAKNETLNQLFYLINELEK

SEQ ID No. 495
MNIKTLLLITSAIFISACSPYIVTANPNHSASKSDEKAEKIKNLF

NEVHTTGVLVIQQGQTQQSYGNDLARASTEYVPASTFKMLNALIG

LEHHKATTTEVFKWDGQKRLFPEWEKDMTLGDAMKASAIPVYQDL

ARRIGLELMSKEVKRVGYGNADIGTQVDNFWLVGPLKITPQQEAQ

FAYKLANKTLPFSPKVQDEVQSMLFIEEKNGNKIYAKSGWGWDVD

PQVGWLTGWVVQPQGNIVAFSLNLEMKKGIPSSVRKEITYKSLEQ

LGIL

SEQ ID No. 496
MKFRHALSSAFVLLGCIAASAHAKTICTAIADAGTGKLLVQDGDC

GRRASPASTFKIAISLMGYDAGFLRNEHDPVLPYRDSYIAWGGEA

WKQPTDPTRWLKYSVVWYSQQVAHHLGAQRFAQYAKAFGYGNADV

SGDPGQNNGLDRAWIGSSLQISPLEQLEFLGKMLNRKLPVSPTAV

DMTERIVESTTLADGTVVHGKTGVSYPLLADGTRDWARGSGWFVG

WIVRGNQTLVFARLTQDERKQPVSAGIRTREAFLRDLPRLLAAR

SEQ ID No. 497
MKFRHALSSAFVLLGCIAASAHAKTICTAIADAGTGKLLVQDGDC

GRRASPASTFKIAISLMGYDAGFLRNEHDPVLPYRDSYIAWGGEA

WKQPTDPTRWLKYPVVWYSQQVAHHLGAQRFAQYAKAFGYGNADV

SGDPGQNNGLDRAWIGSSLQISPLEQLEFLGKMLNRKLPVSPTAV

DMTERIVESTTLADGTVVHGKTGVSYPLLADGTRDWARGSGWFVG

WIVRGKQTLVFARLTQDERKQPVSAGIRTREAFLRDLPRLLAAR

SEQ ID No. 498
MRGKHTVILGAALSALFAGAEGAQMLECTLVADAASGQELYRKGA

CDKAFAPMSTFKVPLAVMGYDAGILVDAHNPRWDYKPEFNGYKFQ

QKTTDPTIWEKDSIVWYSQQLTRKMGQKRFAAYVAGFGYGNGDIS

GEPGKSNGLTHSWLGSSLKISPEGQVRFVRDLLSAKLPASKDAQQ

MTVSILPHFAAGDWAVQGKTGTGSFIDARGAKAPLGWFIGWATHE

ERRVVFARMTAGGKKGEQPAGPAARDAFLKALPDLAKRF

SEQ ID No. 499
MKFRHALSSAFVLLGCIAASAHAKTICTAIADAGTGKLLVQDGDC

GRRASPASTFKIAISLMGYDAGFLRNEHDPVLPYRDSYIAWGGEA

WKQPTDPTRWLKYSVVWYSQQVAHHLGAQRFAQYAKAFGYGNADV

SGDPGQNNGLDRAWIGSSLQISPLEQLEFLGKMLDRKLPVSPTAV

DMTERIVESTTLADGTVVHGKTGVSYPLLADGTRDWARGSGWFVG

WIVRGKQTLVFARLTQDERKQPVSAGIRTREAFLRDLPRLLAAR

SEQ ID No. 500
MKFRHALSSAFVLLGCIAASAHAKTICTAIADAGTGKLLVQDGDC

GRRASPASTFKIAISLMGYDAGFLRNEHDPVLPYRDSYIAWGGEA

WKQPTDPTRWLKYSVVWYSQQVAHHLGAQRFAQYAKAFGYGNADV

SGDPGQNNGLDRAWIGSSLQISPLEQLEFLGKMLNRKLPVSPTAV

DMTERIVESTTLADGTVVHGKTGVSYPLLADGTRDWARGSGWFVG

WIVRGKQTLVFARLTQDERKQPVSAGIRTREAFLRDLPRLLAAR

SEQ ID No. 501
MKTFAAYVIIACLSSTALAGSITENTSWNKEFSAEAVNGVFVLCK

SSSKSCATNDLARASKEYLPVSTFKIPSAIIGLETGVIKNEHQVF

KWDGKPRAMKQWERDLTLRGAIQVSAVPVFQQIAREVGEVRMQKY

LKKFSYGNQNISGGIDKFWLEGQLRISAVNQVEFLESLYLNKLSA

SKENQLIVKEALVTEAAPEYLVHSKTGFSGVGTESNPGVAWWVGW

VEKETEVYFFAFNMDIDNESKLPLRKSIPTKIMESEGIIGG

SEQ ID No. 502
MNIKALLLITSAIFISACSPYIVTANPNHSASKSDEKAEKIKNLF

NEAHTTGVLVIQQGQTQQSYGNDLARASTEYVPASTFKMLNALIG

LEHHKATTTEVFKWDGKKRLFPEWEKDMTLGDAMKASAIPVYQDL

ARRIGLELMSKEVKRVGYGNADIGTQVDNFWLVGPLKITPQQEAQ

FAYKLANKTLPFSQKVQDEVQSMLFIEEKNGNKIYAKSGWGWDVD

PQVGWLTGWVVQPQGNIVAFSLNLEMKKGIPSSVRKEITYKSLEQ

LGIL

SEQ ID No. 503
MNIKALLLITSAIFISACSPYIVSANPNHSASKSDEKAEKIKNLF

NEAHTTGVLVIQQGQTQQSYGNDLARASTEYVPASTFKMLNALIG

LEHHKATTTEVFKWDGQKRLFPEWEKNMTLGDAMKASAIPVYQDL

ARRIGLELMSNEVKRVGYGNADIGTQVDNFWLVGPLKITPQQEAQ

FAYKLANKTLPFSQKVQDEVQSMLFIEEKNGNKIYAKSGWGWDVN

PQVGWLTGWVVQPQGNIVAFSLNLEMKKGIPSSVRKEITYKSLEQ

LGIL

SEQ ID No. 504
MKTFAAYVITACLSSTALASSITENTFWNKEFSAEAVNGVFVLCK

SSSKSCATNNLARASKEYLPASTFKIPNAIIGLETGVIKNEHQVF

KWDGKPRAMKQWERDLSLRGAIQVSAVPVFQQIAREVGEVRMQKY

LKKFSYGNQNISGGIDKFWLEGQLRISAVNQVEFLESLFLNKLSA

SKENQLIVKEALVTEAAPEYLVHSKTGFSGVGTESNPGVAWWVGW

VEKGTEVYFFAFNMDIDNENKLPLRKSIPTKIMASEGIIGG

SEQ ID No. 505
MKTIAAYLVLVFFAGTALSESISENLAWNKEFSSESVHGVFVLCK

SSSNSCTTNNATRASTAYIPASTFKIPNALIGLETGAIKDARQVF
```

-continued

KWDGKPRAMKQWEKDLTLRGAIQVSAVPVFQQIARDIGKKRMQKY

LNLFSYGNANIGGGIDKFWLEGQLRISAVNQVKFLESLYLNNLPA

SKANQLIVKEAIVTEATPEYIVHSKTGYSGVGTESNPGVAWWVGW

VEKGTEVYFFAFNMDIDNESKLPSRKSIPTKIMASEGIIIGG

SEQ ID No. 506
MKKFILPIFSISILVSLSACSSIKTKSEDNFHISSQQHEKAIKSY

FDEAQTQGVIIKEGKNLSTYGNALARANKEYVPASTFKMLIALI

GLENHKATTNEIFKWDGKKRTYPMWEKDMTLGEAMALSAVPVYQE

LARRTGLELMQKEVKRVNFGNTNIGTQVDNFWLVGPLKITPVQEV

NFADDLAHNRLPFKLETQEEVKKMLLIKEVNGSKIYAKSGWGMGV

TPQVGWLTGWVEQANGKKIPFSLNLEMKEGMSGSIRNEITYKSLE

NLGII

SEQ ID No. 507
MNIKALLLITSAIFISACSPYIVTANPNHSASKSDDKAEKIKNLF

NEAHTTGVLVIHQGQTQQSYGNDLARASTEYVPASTFKMLNALIG

LEHHKATTTEVFKWNGQKRLFPEWEKDMTLGDAMKASAIPVYQDL

ARRIGLELMSNEVKRVGYGNADIGTQVDNFWLVGPLKITPQQEAQ

FAYKLANKTLPFSQKVQDEVQSMLFIEEKNGNKIYAKSGWGWDVD

PQVGWLTGWVVQPQGNIVAFSLNLEMKKGIPSSVRKEITYKSLEQ

LGIL

SEQ ID No. 508
MNIKALLLITSAISISACSPYIVTANPNHSASKSDEKAEKIKNLF

NEAHTTGVLVIQQGQTQQSYGNDLARASTEYVPASTFKMLNALIG

LEHHKATTTEVFKWDGQKRLFPEWEKDMTLGDAIKASAIPVYQDL

ARRIGLELMSKEVKRVGYGNADIGTQVDNFWLVGPLKITPQQEAQ

FAYKLANKTLPFSQKVQDEVQSMLFIEEKNGNKIYAKSGWGWDVD

PQVGWLTGWVVQPQGNIVAFSLNLEMKKGIPSSVRKEITYKSLEQ

LGIL said peptides being chosen, preferably, from the peptides of sequence SEQ ID No. 509 to SEQ ID No. 523, SEQ ID No. 525 to SEQ ID No. 572, SEQ ID No. 574 to SEQ ID No. 604, SEQ ID No. 606 to SEQ ID No. 618, SEQ ID No. 620 to SEQ ID No. 696, SEQ ID No. 698 to SEQ ID No. 1077 and SEQ ID No. 1098 to SEQ ID No. 1109, as defined hereafter:

| Peptide SEQ ID No. | Amino acid sequence | Position of the peptide in the OXA protein(s) | Clinical interest |
|---|---|---|---|
| SEQ ID No. 509 | AAAYELAENLFEAGQADGWR | 183-202 for the protein of SEQ No. 433 | 2d |
| SEQ ID No. 510 | AAEGFIPASTFK | 86-97 for the protein of SEQ No. 381 | 2df |
| SEQ ID No. 511 | AALGR | 41-45 for the protein of SEQ No. 382 | 2df |
| SEQ ID No. 512 | ADGQVVAFALNMQMK | 241-255 for the proteins of SEQ No. 410, 413, 458 | 2df |
| SEQ ID No. 513 | ADINEIFK | 95-102 for the protein of SEQ No. 366 | 2df |
| SEQ ID No. 514 | ADWGK | 50-54 for the protein of SEQ No. 382 | 2df |
| SEQ ID No. 515 | AEGAIVISDER | 40-50 for the proteins of SEQ No. 369, 372 | OXA |
| SEQ ID No. 516 | AFALNLDIDK | 222-231 for the protein of SEQ No. 385 | 2d |
| SEQ ID No. 517 | AFAPMSTFK | 49-57 for the protein of SEQ No. 498; 60-68 for the protein of sequence SEQ ID No. 351 | OXA |
| SEQ ID No. 518 | AFGYGNADVSGDPGQNNGLDR | 127-147 for the proteins of SEQ No. 496, 497, 499, 500 | 2d |
| SEQ ID No. 519 | AFTMTK | 174-179 for the protein of SEQ No. 494 | 2de |
| SEQ ID No. 520 | AGDDIALR | 256-263 for the proteins of SEQ No. 410, 413, 458 | 2df |
| SEQ ID No. 521 | AGHVYAFALNIDMPR | 233-247 for the protein of SEQ No. 379 | 2df |
| SEQ ID No. 522 | AGLWR | 11-15 for the protein of SEQ No. 382 | 2df |

| Peptide SEQ ID No. | Amino acid sequence | Position of the peptide in the OXA protein(s) | Clinical interest |
|---|---|---|---|
| SEQ ID No. 523 | AHTEYVPASTFK | 73-84 for the proteins of SEQ No. 447, 466 | 2df |
| SEQ ID No. 524 | AIIPWDGK | 112-119 for the protein of SEQ No. 382 | 2df |
| SEQ ID No. 525 | AIIPWDGKPR | 112-121 for the protein of SEQ No. 382 | 2df |
| SEQ ID No. 526 | AISDITITR | 190-198 for the protein of SEQ No. 386 | 2d |
| SEQ ID No. 527 | AISGK | 82-86 for the protein of SEQ No. 470 | 2df |
| SEQ ID No. 528 | ALGQDR | 121-126 for the protein of SEQ No. 433 | 2d |
| SEQ ID No. 529 | ALPDLAK | 256-262 for the protein of SEQ No. 498 | 2d |
| SEQ ID No. 530 | ALQAK | 254-258 for the protein of SEQ No. 470 | 2df |
| SEQ ID No. 531 | AMETFSPASTFK | 50-61 for the protein of SEQ No. 385 | 2d |
| SEQ ID No. 532 | AMLFLQER | 196-203 for the protein of SEQ No. 469 | 2df |
| SEQ ID No. 533 | AMLVFDPVR | 55-63 for the proteins of SEQ No. 350, 367, 370, 415, 443, 481, 488; 44-52 for the protein of sequence SEQ ID No. 362 | OXA |
| SEQ ID No. 534 | AMTLLESGPGWELHGK | 189-204 for the protein of SEQ No. 380 | 2d |
| SEQ ID No. 535 | ANLHITLHGK | 199-208 for the protein of SEQ No. 386 | 2d |
| SEQ ID No. 536 | ANQLIVK | 183-189 for the proteins of SEQ No. 489, 505 | OXA |
| SEQ ID No. 537 | ANTEYVPASTFK | 71-82 for the proteins of SEQ No. 366, 374, 387, 440, 441, 459, 460, 461, 462, 463, 464, 465, 486, 493; 66-77 for the protein of sequence SEQ ID No. 469 | 2df |
| SEQ ID No. 538 | ANVSR | 133-137 for the protein of SEQ No. 380 | 2d |
| SEQ ID No. 539 | APIGWFIGWATR | 224-235 for the protein of SEQ No. 351 | 2de |
| SEQ ID No. 540 | APLGWFIGWATHEER | 213-227 for the protein of SEQ No. 498 | 2d |
| SEQ ID No. 541 | AQDEVQSMLFIEEK | 196-209 for the protein of SEQ No. 403 | 2df |
| SEQ ID No. 542 | AQGVIVLWNENK | 40-51 for the protein of SEQ No. 384 | 2df |
| SEQ ID No. 543 | ASAIAVYQDLAR | 126-137 for the protein of SEQ No. 467 | 2df |
| SEQ ID No. 544 | ASAILVYQDLAR | 126-137 for the proteins of SEQ No. 417, 426, 457, 472 | 2df |
| SEQ ID No. 545 | ASAIPVYQDLAR | 126-137 for the proteins of SEQ No. 388, 389, 390, 391, 392, 393, 394, 395, 396, 398, 399, 402, 403, 404, 405, 406, 407, 408, 409, 411, 412, 416, 418, 419, 420, 423, 424, 425, 427, 428, 434, 436, 437, 439, 444, 445, 446, 448, 453, 454, 455, 456, 468, 475, 478, 479, | 2df |

| Peptide SEQ ID No. | Amino acid sequence | Position of the peptide in the OXA protein(s) | Clinical interest |
|---|---|---|---|
| | | 480, 482, 483, 495, 502, 503, 507, 508; 120-131 for the proteins of sequence SEQ ID No. 431, 432 | |
| SEQ ID No. 546 | ASAIPVYQDLPR | 126-137 for the protein of SEQ No. 397 | 2df |
| SEQ ID No. 547 | ASAIQVYQDLAR | 126-137 for the proteins of SEQ No. 421, 473 | 2df |
| SEQ ID No. 548 | ASAISVYQDLAR | 126-137 for the proteins of SEQ No. 400, 487 | 2df |
| SEQ ID No. 549 | ASALPVYQDLAR | 126-137 for the proteins of SEQ No. 401, 422 | 2df |
| SEQ ID No. 550 | ASAMPVYQDLAR | 126-137 for the protein of SEQ No. 474 | 2df |
| SEQ ID No. 551 | ASAVPVYQDLAR | 126-137 for the proteins of SEQ No. 438, 451, 452 | 2df |
| SEQ ID No. 552 | ASIEYVPASTFK | 72-83 for the proteins of SEQ No. 399, 403 | 2df |
| SEQ ID No. 553 | ASNVPVYQELAR | 113-124 for the protein of SEQ No. 380 | 2d |
| SEQ ID No. 554 | ASPASTFK | 49-56 for the proteins of SEQ No. 496, 497, 499, 500 | 2d |
| SEQ ID No. 555 | ASTAYIPASTFK | 59-70 for the proteins of SEQ No. 489, 505 | OXA |
| SEQ ID No. 556 | ASTEYVPASTFK | 72-83 for the proteins of SEQ No. 388, 389, 390, 391, 392, 393, 394, 395, 396, 397, 398, 400, 401, 402, 404, 405, 406, 407, 408, 409, 411, 412, 416, 417, 418, 419, 420, 421, 422, 423, 424, 425, 426, 427, 428, 434, 436, 437, 438, 439, 444, 445, 446, 448, 451, 452, 453, 454, 455, 456, 457, 467, 468, 472, 473, 474, 475, 478, 479, 480, 482, 483, 487, 495, 502, 503, 507, 508; 66-77 for the proteins of sequence SEQ ID No. 431, 432 | 2df |
| SEQ ID No. 557 | ASTTEVFK | 96-103 for the protein of SEQ No. 444 | 2df |
| SEQ ID No. 558 | ATSTEIFK | 99-106 for the proteins of SEQ No. 410, 413, 458 | 2df |
| SEQ ID No. 559 | ATTNEIFK | 97-104 for the proteins of SEQ No. 364, 365, 371, 414, 449, 466, 506; 90-97 for the protein of sequence SEQ ID No. 469 | 2df |
| SEQ ID No. 560 | ATTTAVFK | 96-103 for the protein of SEQ No. 396 | 2df |
| SEQ ID No. 561 | ATTTEIFK | 97-104 for the protein of SEQ No. 447; 96-103 for the proteins of sequence SEQ ID No. 399, 403, 411 | 2df |
| SEQ ID No. 562 | ATTTEVFK | 96-103 for the proteins of SEQ No. 388, 389, 390, 391, 392, 393, 394, 397, 398, 400, 401, 402, 404, 405, 406, 407, 408, 409, 412, 416, 417, 418, 419, 420, 421, 422, 423, 424, 425, 426, 427, 434, 436, 437, 438, 439, 445, 446, 448, 451, 452, 453, 454, 455, 456, 457, 467, 468, 472, 473, 474, 475, 478, 479, 480, 482, 483, 487, 495, 502, 503, 507, 508; 90-97 for the proteins of sequence SEQ ID No. 431, 432 | 2df |
| SEQ ID No. 563 | AVSDITILEQTDNYTLHGK | 191-209 for the protein of SEQ No. 477 | OXA |

-continued

| Peptide SEQ ID No. | Amino acid sequence | Position of the peptide in the OXA protein(s) | Clinical interest |
|---|---|---|---|
| SEQ ID No. 564 | AVSDITILEQTYNYTLHGK | 191-209 for the proteins of SEQ No. 429, 430 | 2d |
| SEQ ID No. 565 | AVVPHFEAGDWDVQGK | 195-210 for the protein of SEQ No. 351 | 2de |
| SEQ ID No. 566 | AWEHDMSLR | 100-108 for the protein of SEQ No. 380 | 2d |
| SEQ ID No. 567 | AWIGSSLQISPLEQLEFLGK | 148-167 for the proteins of SEQ No. 496, 497, 499, 500 | 2d |
| SEQ ID No. 568 | CAAQMAPDSTFK | 63-74 for the protein of SEQ No. 376 | 2d |
| SEQ ID No. 569 | CATQMAPDSTFK | 48-59 for the protein of SEQ No. 361; 63-74 for the protein of sequence SEQ ID No. 360 | 2d |
| SEQ ID No. 570 | CTIIADAITGNTLYETGECAR | 32-52 for the protein of SEQ No. 349 | 2d |
| SEQ ID No. 571 | DAFLK | 251-255 for the protein of SEQ No. 498 | 2d |
| SEQ ID No. 572 | DDFILHGK | 189-196 for the protein of SEQ No. 377 | 2d |
| SEQ ID No. 573 | DDQEVLPYGGK | 92-102 for the protein of SEQ No. 379 | 2df |
| SEQ ID No. 574 | DDVLK | 87-91 for the protein of SEQ No. 470 | 2df |
| SEQ ID No. 575 | DEFHVFR | 90-96 for the proteins of SEQ No. 355, 363 | 2d |
| SEQ ID No. 576 | DEFQIFR | 90-96 for the proteins of SEQ No. 350, 367, 370, 375, 415, 443, 481, 488; 79-85 for the protein of sequence SEQ ID No. 362 | OXA |
| SEQ ID No. 577 | DEFQVFR | 90-96 for the proteins of SEQ No. 356, 369, 372, 373, 484, 491 | 2d |
| SEQ ID No. 578 | DELVR | 260-264 for the protein of SEQ No. 433 | 2d |
| SEQ ID No. 579 | DETSR | 112-116 for the protein of SEQ No. 381 | 2df |
| SEQ ID No. 580 | DFDYGNQDFSGDK | 141-153 for the proteins of SEQ No. 360, 376; 126-138 for the protein of sequence SEQ ID No. 361 | 2d |
| SEQ ID No. 581 | DFTLGEAMQASTVPVYQELAR | 120-140 for the proteins of SEQ No. 410, 413, 458 | 2df |
| SEQ ID No. 582 | DGNITSVAINIDMLSEADAPK | 250-270 for the protein of SEQ No. 382 | 2df |
| SEQ ID No. 583 | DHDLITAMK | 108-116 for the proteins of SEQ No. 384, 485 | 2df |
| SEQ ID No. 584 | DIAAWNR | 101-107 for the proteins of SEQ No. 384, 485 | 2df |
| SEQ ID No. 585 | DIGEDK | 131-136 for the protein of SEQ No. 373 | 2d |
| SEQ ID No. 586 | DILYIQELAGGWK | 180-192 for the protein of SEQ No. 494 | 2de |
| SEQ ID No. 587 | DITILEK | 181-187 for the protein of SEQ No. 377 | 2d |

-continued

| Peptide SEQ ID No. | Amino acid sequence | Position of the peptide in the OXA protein(s) | Clinical interest |
|---|---|---|---|
| SEQ ID No. 588 | DLLSAK | 166-171 for the protein of SEQ No. 498 | 2d |
| SEQ ID No. 589 | DLMITEAGR | 195-203 for the proteins of SEQ No. 369, 372, 373 | 2d |
| SEQ ID No. 590 | DLMIVEAGR | 195-203 for the proteins of SEQ No. 350, 356, 367, 370, 375, 415, 443, 481, 488, 491; 184-192 for the protein of sequence SEQ ID No. 362 | OXA |
| SEQ ID No. 591 | DLMIVEAK | 195-202 for the proteins of SEQ No. 355, 363 | 2d |
| SEQ ID No. 592 | DLPLR | 243-247 for the protein of SEQ No. 470 | 2df |
| SEQ ID No. 593 | DLSGNPGK | 131-138 for the protein of SEQ No. 347 | 2d |
| SEQ ID No. 594 | DLSLR | 105-109 for the proteins of SEQ No. 357, 358, 359, 368, 383, 442, 471, 504; 106-110 for the protein of sequence SEQ ID No. 490 | OXA |
| SEQ ID No. 595 | DLTLR | 105-109 for the proteins of SEQ No. 352, 435, 492, 501, 505; 96-100 for the proteins of sequence SEQ ID No. 348, 353, 354 | OXA |
| SEQ ID No. 596 | DMTLGDAIK | 117-125 for the proteins of SEQ No. 468, 508 | 2df |
| SEQ ID No. 597 | DMTLGDAMALSAVPVYQELAR | 118-138 for the protein of SEQ No. 447 | 2df |
| SEQ ID No. 598 | DMTLGDAMK | 117-125 for the proteins of SEQ No. 389, 390, 391, 394, 395, 398, 399, 400, 401, 403, 404, 407, 408, 409, 411, 412, 417, 418, 420, 421, 423, 425, 426, 427, 428, 436, 437, 438, 439, 444, 451, 452, 453, 454, 455, 456, 457, 467, 472, 473, 474, 478, 479, 480, 482, 483, 487, 495, 502, 507 | 2df |
| SEQ ID No. 599 | DMTLGEAMALSAVPVYQDLAR | 118-138 for the protein of SEQ No. 466 | 2df |
| SEQ ID No. 600 | DMTLGEAMALSAVPVYQELAR | 118-138 for the proteins of SEQ No. 364, 365, 371, 414, 449, 506 | 2df |
| SEQ ID No. 601 | DMTLGEAMK | 116-124 for the proteins of SEQ No. 366, 374, 387, 440, 441, 459, 460, 461, 462, 463, 464, 465, 486, 493 | 2df |
| SEQ ID No. 602 | DMTLGQAMQASAVPVYQELAR | 111-131 for the protein of SEQ No. 469 | 2df |
| SEQ ID No. 603 | DNNGK | 214-218 for the protein of SEQ No. 349 | 2d |
| SEQ ID No. 604 | DQDLR | 110-114 for the proteins of SEQ No. 350, 356, 367, 369, 370, 372, 373, 375, 415, 443, 481, 484, 488, 491; 99-103 for the protein of sequence SEQ ID No. 362 | 2d |
| SEQ ID No. 605 | DQQIGWFVGWASK | 213-225 for the protein of SEQ No. 347 | 2d |
| SEQ ID No. 606 | DQQIGWFVGWASKPGK | 213-228 for the protein of SEQ No. 347 | 2d |
| SEQ ID No. 607 | DQQVQVYGNDLNR | 53-65 for the protein of SEQ No. 469 | 2df |
| SEQ ID No. 608 | DQSFR | 132-136 for the protein of SEQ No. 381 | 2df |

-continued

| Peptide SEQ ID No. | Amino acid sequence | Position of the peptide in the OXA protein(s) | Clinical interest |
|---|---|---|---|
| SEQ ID No. 609 | DQTLESAFK | 105-113 for the protein of SEQ No. 470 | 2df |
| SEQ ID No. 610 | DSCVWYSQVLTQQLGMTR | 98-115 for the protein of SEQ No. 494 | 2de |
| SEQ ID No. 611 | DSIVWYSQELTR | 113-124 for the protein of SEQ No. 351 | 2de |
| SEQ ID No. 612 | DSIVWYSQQLTR | 102-113 for the protein of SEQ No. 498 | 2d |
| SEQ ID No. 613 | DSNLR | 109-113 for the proteins of SEQ No. 429, 430, 477; 96-100 for the proteins of sequence SEQ ID No. 377, 386 | 2d |
| SEQ ID No. 614 | DSYIAWGGEAWK | 81-92 for the proteins of SEQ No. 496, 497, 499, 500 | 2d |
| SEQ ID No. 615 | DTLNPEWPYK | 67-76 for the protein of SEQ No. 494 | 2de |
| SEQ ID No. 616 | DVDEVFYK | 88-95 for the proteins of SEQ No. 386, 429, 430, 477 | 2d |
| SEQ ID No. 617 | DVSGDPGK | 144-151 for the protein of SEQ No. 351 | 2de |
| SEQ ID No. 618 | DWILR | 204-208 for the proteins of SEQ No. 355, 363 | 2d |
| SEQ ID No. 619 | DWPAMAGAWR | 265-274 for the protein of SEQ No. 433 | 2d |
| SEQ ID No. 620 | EAFLR | 256-260 for the proteins of SEQ No. 496, 497, 499, 500 | 2d |
| SEQ ID No. 621 | EAIAR | 250-254 for the proteins of SEQ No. 355, 363, 369, 372, 373, 375, 484 | 2d |
| SEQ ID No. 622 | EAIVR | 250-254 for the proteins of SEQ No. 350, 356, 367, 370, 415, 443, 481, 488, 491; 239-243 for the protein of sequence SEQ ID No. 362 | OXA |
| SEQ ID No. 623 | EAIVTEATPEYIVHSK | 190-205 for the proteins of SEQ No. 489, 505 | OXA |
| SEQ ID No. 624 | EALVTEAAPEYLVHSK | 190-205 for the proteins of SEQ No. 352, 357, 358, 359, 368, 383, 435, 442, 471, 492, 501, 504; 181-196 for the proteins of sequence SEQ ID No. 348, 353, 354 | OXA |
| SEQ ID No. 625 | EALVTEAPEYLVHSK | 191-205 for the protein of SEQ No. 490 | 2d |
| SEQ ID No. 626 | EEIVR | 240-244 for the protein of SEQ No. 377 | 2d |
| SEQ ID No. 627 | EEVLAALPAQLK | 251-262 for the protein of SEQ No. 347 | 2d |
| SEQ ID No. 628 | EFNGSK | 209-214 for the protein of SEQ No. 447 | 2df |
| SEQ ID No. 629 | EFSAEAVNGVFVLCK | 31-45 for the proteins of SEQ No. 352, 357, 359, 368, 383, 435, 442, 471, 490, 492, 501, 504; 22-36 for the proteins of sequence SEQ ID No. 348, 353, 354 | OXA |
| SEQ ID No. 630 | EFSSESVHGVFVLCK | 31-45 for the proteins of SEQ No, 489, 505 | OXA |
| SEQ ID No. 631 | EGDMAK | 248-253 for the protein of SEQ No, 379 | 2df |

-continued

| Peptide SEQ ID No. | Amino acid sequence | Position of the peptide in the OXA protein(s) | Clinical interest |
|---|---|---|---|
| SEQ ID No. 632 | EGMTGSIR | 254-261 for the proteins of SEQ No. 364, 371, 414, 449, 506 | 2df |
| SEQ ID No. 633 | EGMTGSIR | 254-261 for the protein of SEQ No. 365 | 2df |
| SEQ ID No. 634 | EGSCDK | 54-59 for the protein of SEQ No. 351 | 2de |
| SEQ ID No. 635 | EIAVWNR | 125-131 for the protein of SEQ No. 381 | 2d1 |
| SEQ ID No. 636 | EIAYK | 262-266 for the protein of SEQ No. 480 | 2df |
| SEQ ID No. 637 | EIFER | 20-24 for the protein of SEQ No. 377 | 2d |
| SEQ ID No. 638 | EIFYHYR | 79-85 for the protein of SEQ No. 385 | 2d |
| SEQ ID No. 639 | EIGDDK | 131-136 for the proteins of SEQ No. 350, 367, 370, 415, 443, 481, 488; 120-125 for the protein of sequence SEQ ID No. 362 | OXA |
| SEQ ID No. 640 | EIGDGK | 131-136 for the protein of SEQ No. 375 | 2d |
| SEQ ID No. 641 | EIGEDK | 131-136 for the proteins of SEQ No. 356, 372, 491 | 2d |
| SEQ ID No. 642 | EIGEDNAR | 131-138 for the protein of SEQ No. 484 | OXA |
| SEQ ID No. 643 | EIGENK | 131-136 for the proteins of SEQ No. 355, 363 | 2d |
| SEQ ID No. 644 | EIGPK | 153-157 for the protein of SEQ No. 381 | 2df |
| SEQ ID No. 645 | EIGSEIDK | 136-143 for the protein of SEQ No. 377 | 2d |
| SEQ ID No. 646 | EITYK | 262-266 for the proteins of SEQ No. 389, 390, 391, 392, 393, 394, 395, 396, 397, 398, 399, 400, 401, 402, 403, 404, 405, 406, 407, 408, 409, 411, 412, 416, 417, 418, 419, 420, 421, 422, 423, 424, 425, 426, 427, 428, 434, 436, 437, 438, 444, 445, 446, 448, 451, 452, 453, 454, 455, 456, 457, 467, 468, 472, 473, 474, 475, 478, 479, 482, 483, 487, 495, 502, 503, 507, 508; 263-267 for the proteins of sequence SEQ ID No. 364, 365, 371, 414, 447, 449, 466, 506; 256-260 for the proteins of sequence SEQ ID No. 431, 432 | 2df |
| SEQ ID No. 647 | EITYR | 262-266 for the protein of SEQ No. 388 | 2df |
| SEQ ID No. 648 | EMIYLK | 181-186 for the protein of SEQ No. 385 | 2d |
| SEQ ID No. 649 | EMLYVER | 205-211 for the proteins of SEQ No. 410, 413, 458 | 2df |
| SEQ ID No. 650 | EMTYK | 262-266 for the protein of SEQ No. 439 | 2df |
| SEQ ID No. 651 | ENIEK | 138-142 for the proteins of SEQ No. 429, 430, 477; 137-141 for the protein of sequence SEQ ID No. 386 | 2d |
| SEQ ID No. 652 | ENQLIVK | 183-189 for the proteins of SEQ No. 352, 357, 358, 359, 368, 383, 435, 442, 471, 492, | OXA |

-continued

| Peptide SEQ ID No. | Amino acid sequence | Position of the peptide in the OXA protein(s) | Clinical interest |
|---|---|---|---|
| | | 501, 504; 174-180 for the proteins of sequence SEQ ID No. 348, 353, 354; 184-190 for the protein of sequence SEQ ID No. 490 | |
| SEQ ID No. 653 | EQAILLFR | 156-163 for the protein of SEQ No. 385 | 2d |
| SEQ ID No. 654 | EQIQFLLR | 165-172 for the protein of SEQ No. 349 | 2d |
| SEQ ID No. 655 | EQLAFDPQVQQQVK | 182-195 for the protein of SEQ No. 469 | 2df |
| SEQ ID No. 656 | EQVDFVQR | 189-196 for the protein of SEQ No. 382 | 2df |
| SEQ ID No. 657 | ETEVYFFAFNMDIDNESK | 229-246 for the proteins of SEQ No. 352, 435, 492, 501; 220-237 for the proteins of sequence SEQ ID No. 348, 353, 354 | OXA |
| SEQ ID No. 658 | ETTTPR | 90-95 for the protein of SEQ No. 347 | 2d |
| SEQ ID No. 659 | EVGEIR | 126-131 for the protein of SEQ No. 489 | 2d |
| SEQ ID No. 660 | EVGEVR | 126-131 for the proteins of SEQ No. 352, 357, 358, 359, 368, 383, 435, 442, 471, 492, 501, 504; 117-122 for the proteins of sequence SEQ ID No. 348, 353, 354; 127-132 for the protein of sequence SEQ ID No. 490 | OXA |
| SEQ ID No. 661 | EVNGSK | 209-214 for the proteins of SEQ No. 364, 365, 371, 414, 449, 466, 506 | 2df |
| SEQ ID No. 662 | EWQENK | 24-29 for the proteins of SEQ No. 378, 450, 476, 485 | 2df |
| SEQ ID No. 663 | EYELYLNVWK | 78-87 for the protein of SEQ No. 494 | 2de |
| SEQ ID No. 664 | EYLPASTFK | 62-70 for the proteins of SEQ No. 352, 357, 359, 368, 383, 435, 442, 471, 492, 504; 53-61 for the proteins of sequence SEQ ID No. 348, 353, 354; 63-71 for the protein of sequence SEQ ID No. 490 | OXA |
| SEQ ID No. 665 | EYLPVSTFK | 62-70 for the protein of SEQ No. 501 | 2de |
| SEQ ID No. 666 | EYNTSGTFVFYDGK | 27-40 for the protein of SEQ No. 385 | 2d |
| SEQ ID No. 667 | EYVPASTFK | 75-83 for the proteins of SEQ No. 388, 389, 390, 391, 392, 393, 394, 395, 396, 397, 398, 399, 400, 401, 402, 403, 404, 405, 406, 407, 408, 409, 411, 412, 416, 417, 418, 419, 420, 421, 422, 423, 424, 425, 426, 427, 428, 434, 436, 437, 438, 439, 444, 445, 446, 448, 451, 452, 453, 454, 455, 456, 457, 467, 468, 472, 473, 474, 475, 478, 479, 480, 482, 483, 487, 495, 502, 503, 507, 508; 69-77 for the proteins of sequence SEQ ID No. 431, 432, 469; 74-82 for the proteins of sequence SEQ ID No. 366, 374, 387, 440, 441, 459, 460, 461, 462, 463, 464, 465, 486, 493; 76-84 for the proteins of sequence SEQ ID No. 364, 365, 371, 414, 447, 449, 466, 506 | 2df |
| SEQ ID No. 668 | FAAYVAGFGYGNGDISGEPGK | 120-140 for the protein of SEQ No. 498 | 2d |

-continued

| Peptide SEQ ID No. | Amino acid sequence | Position of the peptide in the OXA protein(s) | Clinical interest |
|---|---|---|---|
| SEQ ID No. 669 | FAPESTFK | 45-52 for the protein of SEQ No. 494 | 2de |
| SEQ ID No. 670 | FAQYAK | 121-126 for the proteins of SEQ No. 496, 497, 499, 500 | 2d |
| SEQ ID No. 671 | FDYGNK | 138-143 for the protein of SEQ No. 351 | 2de |
| SEQ ID No. 672 | FDYGNR | 146-151 for the protein of SEQ No. 379; 125-130 for the protein of sequence SEQ ID No. 347 | 2d |
| SEQ ID No. 673 | FEDLYK | 232-237 for the protein of SEQ No, 385 | 2d |
| SEQ ID No. 674 | FEDTFHISNQK | 27-37 for the protein of SEQ No. 466 | 2df |
| SEQ ID No. 675 | FEDTFHTSNQQHEK | 27-40 for the protein of SEQ No. 447 | 2df |
| SEQ ID No. 676 | FEYGNQDVSGDSGK | 133-146 for the protein of SEQ No. 349 | 2d |
| SEQ ID No. 677 | FFSDFQAK | 34-41 for the protein of SEQ No. 375 | 2d |
| SEQ ID No. 678 | FFSDLQAEGAIVIADER | 34-50 for the proteins of SEQ No. 373, 484 | 2d |
| SEQ ID No. 679 | FFSDLR | 34-39 for the proteins of SEQ No, 369, 372 | OXA |
| SEQ ID No. 680 | FFSEFQAK | 34-41 for the proteins of SEQ No. 350, 356, 367, 370, 415, 443, 481, 488, 491; 23-30 for the protein of sequence SEQ ID No. 362 | OXA |
| SEQ ID No. 681 | FGLEGQLR | 153-160 for the protein of SEQ No. 359 | 2de |
| SEQ ID No. 682 | FILPIFSISILVSLSACSSIK | 4-24 for the proteins of SEQ No. 364, 365, 371, 414, 449, 506 | 2df |
| SEQ ID No. 683 | FLALLFSAVVLVSLGHAQDK | 5-24 for the protein of SEQ No. 363 | 2d |
| SEQ ID No. 684 | FLALLFSAVVLVSLGHAQEK | 5-24 for the protein of SEQ No. 355 | 2d |
| SEQ ID No. 685 | FLESLYLNNLPASK | 169-182 for the proteins of SEQ No. 489, 505 | OXA |
| SEQ ID No. 686 | FLLEGQLR | 153-160 for the protein of SEQ No. 442 | 2de |
| SEQ ID No. 687 | FQQYVDR | 118-124 for the protein of SEQ No. 347 | 2d |
| SEQ ID No. 688 | FSDYVQR | 131-137 for the protein of SEQ No. 351 | 2de |
| SEQ ID No. 689 | FSTASTFK | 63-70 for the protein of SEQ No. 470 | 2df |
| SEQ ID No. 690 | FSWDGK | 117-122 for the protein of SEQ No. 381 | 2df |
| SEQ ID No. 691 | FSYGNQNISGGIDK | 139-152 for the proteins of SEQ No. 352, 357, 358, 359, 368, 383, 435, 442, 501, 504; 130-143 for the proteins of sequence SEQ ID No. 348, 353, 354; 140-153 for the protein of sequence SEQ ID No. 490 | OXA |

-continued

| Peptide SEQ ID No. | Amino acid sequence | Position of the peptide in the OXA protein(s) | Clinical interest |
|---|---|---|---|
| SEQ ID No. 692 | FSYGNQNISGGTDK | 139-152 for the protein of SEQ No. 471 | 2de |
| SEQ ID No. 693 | FSYGSQNISGGIDK | 139-152 for the protein of SEQ No. 492 | 2de |
| SEQ ID No. 694 | FTEYVK | 126-131 for the protein of SEQ No. 349 | 2d |
| SEQ ID No. 695 | FVAHK | 173-177 for the protein of SEQ No. 349 | 2d |
| SEQ ID No. 696 | FVPASTYK | 62-69 for the protein of SEQ No. 380 | 2d |
| SEQ ID No. 697 | FVYDLAQGQLPFK | 184-196 for the proteins of SEQ No. 410, 413, 458 | 2df |
| SEQ ID No. 698 | FVYDLAQGQLPFKPEVQQQVK | 184-204 for the proteins of SEQ No. 410, 413, 458 | 2df |
| SEQ ID No. 699 | FWLEDQLR | 153-160 for the proteins of SEQ No. 358, 435, 471, 492; 144-151 for the proteins of sequence SEQ ID No. 348, 353 | 2de |
| SEQ ID No. 700 | FWLEGPLK | 144-151 for the protein of SEQ No. 377 | 2d |
| SEQ ID No. 701 | FWLEGQLR | 153-160 for the proteins of SEQ No. 352, 357, 368, 383, 489, 501, 504, 505; 144-151 for the protein of sequence SEQ ID No. 354; 154-161 for the protein of sequence SEQ ID No. 490 | OXA |
| SEQ ID No. 702 | FYPASSFK | 53-60 for the protein of SEQ No. 377 | 2d |
| SEQ ID No. 703 | FYPASTFK | 66-73 for the proteins of SEQ No. 386, 429, 430, 477 | 2d |
| SEQ ID No. 704 | GACDK | 44-48 for the protein of SEQ No. 498 | 2d |
| SEQ ID No. 705 | GAEVYFFAFNMDIDNENK | 229-246 for the proteins of SEQ No. 383, 490 | 2d |
| SEQ ID No. 706 | GAIQVSAVPVFQQIAR | 110-125 for the proteins of SEQ No. 352, 357, 358, 359, 368, 383, 435, 442, 471, 489, 492, 501, 504, 505; 101-116 for the proteins of sequence SEQ ID No. 348, 354; 111-126 for the protein of sequence SEQ ID No. 490 | OXA |
| SEQ ID No. 707 | GAIQVSAVPVFQQITR | 101-116 for the protein of SEQ No. 353 | 2de |
| SEQ ID No. 708 | GDYWIDGNLEISAHEQISFLR | 156-176 for the proteins of SEQ No. 369, 372 | OXA |
| SEQ ID No. 709 | GDYWIDGNLK | 156-165 for the protein of SEQ No. 373 | 2d |
| SEQ ID No. 710 | GELPVSEDALEMTK | 181-194 for the protein of SEQ No. 351 | 2de |
| SEQ ID No. 711 | GEQPAGPAAR | 241-250 for the protein of SEQ No. 498; 252-261 for the protein of sequence SEQ ID No. 351 | OXA |
| SEQ ID No. 712 | GFAGHNQDQDLR | 103-114 for the proteins of SEQ No, 350, 367, 370, 415, 443, 481, 488; 92-103 for the protein of sequence SEQ ID No. 362 | OXA |
| SEQ ID No. 713 | GIPSSVR | 254-260 for the proteins of SEQ No. 389, 390, 391, 392, 393, 394, 395, 397, 398, 399, 400, 401, 402, 403, 404, 405, 406, 407, 408, | 2df |

| Peptide SEQ ID No. | Amino acid sequence | Position of the peptide in the OXA protein(s) | Clinical interest |
|---|---|---|---|
| | | 409, 411, 412, 416, 417, 418, 419, 420, 421, 422, 423, 424, 425, 426, 427, 428, 434, 436, 437, 438, 439, 444, 445, 446, 448, 451, 452, 453, 454, 455, 456, 457, 467, 468, 472, 473, 474, 475, 478, 479, 480, 482, 483, 487, 495, 502, 503, 507, 508; 248-254 for the proteins of sequence SEQ ID No. 431, 432 | |
| SEQ ID No. 714 | GISSSVR | 254-260 for the protein of SEQ No. 388 | 2df |
| SEQ ID No. 715 | GLNGTFVVYDLK | 26-37 for the protein of SEQ No. 377 | 2d |
| SEQ ID No. 716 | GMEIWNSNHTPK | 101-112 for the proteins of SEQ No. 360, 376; 86-97 for the protein of sequence SEQ ID No. 361 | 2d |
| SEQ ID No. 717 | GNQTLVFAR | 230-238 for the protein of SEQ No. 496 | 2d |
| SEQ ID No. 718 | GNYWIDGNLEISAHEQISFLR | 156-176 for the protein of SEQ No. 484 | OXA |
| SEQ ID No. 719 | GPLEISAFEEAR | 164-175 for the protein of SEQ No. 379 | 2df |
| SEQ ID No. 720 | GPLTITPIQEVK | 172-183 for the proteins of SEQ No. 410, 413, 458 | 2df |
| SEQ ID No. 721 | GSGWFVGWIVR | 219-229 for the proteins of SEQ No. 496, 497, 499, 500 | 2d |
| SEQ ID No. 722 | GSLLLWDQK | 66-74 for the protein of SEQ No. 381 | 2df |
| SEQ ID No. 723 | GTEVYFFAFNMDIDNENK | 229-246 for the proteins of SEQ No. 357, 358, 359, 368, 442, 471, 504 | OXA |
| SEQ ID No. 724 | GTEVYFFAFNMDIDNESK | 229-246 for the proteins of SEQ No. 489, 505 | OXA |
| SEQ ID No. 725 | GTFVLYDVQR | 38-47 for the protein of SEQ No. 380 | 2d |
| SEQ ID No. 726 | GTIVVADER | 42-50 for the proteins of SEQ No. 350, 356, 367, 370, 375, 415, 443, 481, 488, 491; 31-39 for the protein of sequence SEQ ID No. 362 | OXA |
| SEQ ID No. 727 | GTIVVLDAR | 63-71 for the protein of SEQ No, 382 | 2df |
| SEQ ID No. 728 | GTIVVVDER | 42-50 for the proteins of SEQ No. 355, 363 | 2d |
| SEQ ID No. 729 | GTLPFSAR | 200-207 for the protein of SEQ No. 382 | 2df |
| SEQ ID No. 730 | GTPSSVR | 254-260 for the protein of SEQ No. 396 | 2df |
| SEQ ID No. 731 | HALSSAFVLLGCIAASAHAK | 5-24 for the proteins of SEQ No. 496, 497, 499, 500 | 2d |
| SEQ ID No. 732 | HIADSK | 234-239 for the protein of SEQ No. 494 | 2de |
| SEQ ID No. 733 | HNGLTHAWLASSLK | 152-165 for the protein of SEQ No. 351 | 2de |
| SEQ ID No. 734 | HNGLTQSWLMSSLTISPK | 147-164 for the protein of SEQ No. 349 | 2d |
| SEQ ID No. 735 | HNGTDGAWIISSLR | 148-161 for the protein of SEQ No. 433 | 2d |

-continued

| Peptide SEQ ID No. | Amino acid sequence | Position of the peptide in the OXA protein(s) | Clinical interest |
|---|---|---|---|
| SEQ ID No. 736 | HTLSVFDQER | 54-63 for the protein of SEQ No. 373 | 2d |
| SEQ ID No. 737 | HVTFASFR | 241-248 for the protein of SEQ No. 494 | 2de |
| SEQ ID No. 738 | IAISLMGYDAGFLR | 57-70 for the proteins of SEQ No. 496, 497, 499, 500 | 2d |
| SEQ ID No. 739 | IALSLMAFDAEIIDQK | 75-90 for the proteins of SEQ No. 360, 376; 60-75 for the protein of sequence SEQ ID No. 361 | 2d |
| SEQ ID No. 740 | IALSLMGFDSGILK | 53-66 for the protein of SEQ No. 494 | 2de |
| SEQ ID No. 741 | IANALIGLENHK | 87-98 for the proteins of SEQ No. 410, 413, 458 | 2df |
| SEQ ID No. 742 | IAWIVGFVYLK | 205-215 for the protein of SEQ No. 385 | 2d |
| SEQ ID No. 743 | IDTFWLDNSLK | 141-151 for the protein of SEQ No. 385 | 2d |
| SEQ ID No. 744 | IDYYNLDR | 41-48 for the protein of SEQ No. 377 | 2d |
| SEQ ID No. 745 | IFNALIALDSGVIK | 62-75 for the protein of SEQ No. 385 | 2d |
| SEQ ID No. 746 | IFNSLLALDSGALDNER | 95-111 for the protein of SEQ No. 382 | 2df |
| SEQ ID No. 747 | IFNTLIGLENGIVK | 61-74 for the protein of SEQ No. 377 | 2d |
| SEQ ID No. 748 | IGLDLMQK | 138-145 for the proteins of SEQ No. 366, 374, 387, 440, 441, 459, 460, 461, 462, 463, 464, 465, 486, 493 | 2df |
| SEQ ID No. 749 | IGLEK | 131-135 for the protein of SEQ No. 477 | OXA |
| SEQ ID No. 750 | IGLELMQQEVQR | 133-144 for the protein of SEQ No. 469 | 2df |
| SEQ ID No. 751 | IGLELMSK | 139-146 for the proteins of SEQ No. 389, 390, 391, 393, 395, 398, 399, 400, 401, 402, 403, 404, 408, 409, 411, 412, 417, 419, 420, 421, 422, 423, 424, 425, 426, 427, 428, 436, 437, 438, 439, 451, 452, 453, 454, 455, 456, 457, 467, 468, 472, 473, 474, 478, 479, 480, 482, 483, 487, 495, 502, 508 | 2df |
| SEQ ID No. 752 | IGLELMSNEVK | 139-149 for the proteins of SEQ No. 388, 392, 394, 396, 397, 405, 406, 407, 416, 418, 434, 444, 445, 446, 448, 475, 503, 507; 133-143 for the proteins of sequence SEQ ID No. 431, 432 | 2df |
| SEQ ID No. 753 | IGLER | 126-130 for the protein of SEQ No. 380 | 2d |
| SEQ ID No. 754 | IGLNK | 130-134 for the proteins of SEQ No. 360, 376; 115-119 for the protein of sequence SEQ ID No. 361 | 2d |
| SEQ ID No. 755 | IGLNLMQK | 140-147 for the protein of SEQ No. 466 | 2df |
| SEQ ID No. 756 | IGPSLMQSELQR | 142-153 for the proteins of SEQ No. 410, 413, 458 | 2df |

-continued

| Peptide SEQ ID No. | Amino acid sequence | Position of the peptide in the OXA protein(s) | Clinical interest |
|---|---|---|---|
| SEQ ID No. 757 | IGYGNMQIGTEVDQFWLK | 154-171 for the proteins of SEQ No. 413, 458 | 2df |
| SEQ ID No. 758 | IGYGNMQMGTEVDQFWLK | 154-171 for the protein of SEQ No. 410 | 2df |
| SEQ ID No. 759 | IINHNLPVK | 167-175 for the protein of SEQ No. 361; 182-190 for the protein of sequence SEQ ID No. 360 | 2d |
| SEQ ID No. 760 | IINHNLPVR | 182-190 for the protein of SEQ No. 376 | 2d |
| SEQ ID No. 761 | ILFQQGTQQACAER | 41-54 for the protein of SEQ No. 433 | 2d |
| SEQ ID No. 762 | ILNNWFK | 20-26 for the protein of SEQ No. 385 | 2d |
| SEQ ID No. 763 | ILNTLISLEEK | 71-81 for the protein of SEQ No. 470 | 2df |
| SEQ ID No. 764 | ILSLVCLSISIGACAEHSMSR | 6-26 for the proteins of SEQ No. 410, 413, 458 | 2df |
| SEQ ID No. 765 | INESR | 219-223 for the protein of SEQ No. 349 | 2d |
| SEQ ID No. 766 | INIVK | 255-259 for the proteins of SEQ No. 429, 430, 477; 254-258 for the protein of sequence SEQ ID No. 386 | 2d |
| SEQ ID No. 767 | INLYGNALSR | 61-70 for the proteins of SEQ No. 366, 374, 387, 440, 441, 459, 460, 461, 462, 463, 464, 465, 486, 493 | 2df |
| SEQ ID No. 768 | IPFSLNLEMK | 244-253 for the proteins of SEQ No. 364, 365, 371, 414, 449, 506 | 2df |
| SEQ ID No. 769 | IPHTLFALDADAVR | 76-89 for the protein of SEQ No. 373 | 2d |
| SEQ ID No. 770 | IPHTLFALDAGAAR | 76-89 for the proteins of SEQ No, 356, 491 | 2d |
| SEQ ID No. 771 | IPHTLFALDAGAVR | 76-89 for the proteins of SEQ No. 350, 355, 363, 367, 370, 375, 415, 443, 481, 488; 65-78 for the protein of sequence SEQ ID No. 362 | OXA |
| SEQ ID No. 772 | IPLGK | 255-259 for the protein of SEQ No. 379 | 2df |
| SEQ ID No. 773 | IPNAIIGLETGVIK | 71-84 for the proteins of SEQ No. 352, 358, 359, 368, 383, 442, 471, 492, 504; 62-75 for the proteins of sequence SEQ ID No. 348, 353; 72-85 for the protein of sequence SEQ ID No. 490 | OXA |
| SEQ ID No. 774 | IPNALIGLETGAIK | 71-84 for the proteins of SEQ No. 489, 505 | OXA |
| SEQ ID No. 775 | IPNSLIAFDTGAVR | 78-91 for the protein of SEQ No. 379 | 2df |
| SEQ ID No. 776 | IPSAIIGLETGVIK | 71-84 for the proteins of SEQ No. 357, 435, 501; 62-75 for the protein of sequence SEQ ID No. 354 | 2de |
| SEQ ID No. 777 | ISAFNQVK | 161-168 for the protein of SEQ No. 489 | 2d |
| SEQ ID No. 778 | ISAHEQILFLR | 166-176 for the protein of SEQ No. 373 | 2d |
| SEQ ID No. 779 | ISAMEQTR | 160-167 for the protein of SEQ No. 380 | 2d |

-continued

| Peptide SEQ ID No. | Amino acid sequence | Position of the peptide in the OXA protein(s) | Clinical interest |
|---|---|---|---|
| SEQ ID No. 780 | ISAMEQVK | 165-172 for the proteins of SEQ No. 429, 477; 152-159 for the protein of sequence SEQ ID No. 377; 164-171 for the protein of sequence SEQ ID No. 386 | 2d |
| SEQ ID No. 781 | ISATEQVAFLR | 164-174 for the protein of SEQ No. 384 | 2df |
| SEQ ID No. 782 | ISATQQIAFLR | 164-174 for the protein of SEQ No. 485 | 2df |
| SEQ ID No. 783 | ISAVNQVEFLESLFLNK | 161-177 for the proteins of SEQ No. 357, 358, 359, 368, 383, 442, 471, 504; 162-178 for the protein of sequence SEQ ID No. 490 | OXA |
| SEQ ID No. 784 | ISAVNQVEFLESLYLNK | 161-177 for the proteins of SEQ No. 352, 435, 492, 501; 152-168 for the proteins of sequence SEQ ID No. 348, 353, 354 | OXA |
| SEQ ID No. 785 | ISAVNQVK | 161-168 for the protein of SEQ No. 505 | 2de |
| SEQ ID No. 786 | ISPEEQIQFLR | 170-180 for the proteins of SEQ No. 360, 376; 155-165 for the protein of sequence SEQ ID No. 361 | 2d |
| SEQ ID No. 787 | ISPEEQVR | 166-173 for the protein of SEQ No. 351 | 2de |
| SEQ ID No. 788 | ISPEGQVR | 155-162 for the protein of SEQ No. 498 | 2d |
| SEQ ID No. 789 | ISPLEQLAFLR | 162-172 for the protein of SEQ No. 433 | 2d |
| SEQ ID No. 790 | ITAFQQVDFLR | 188-198 for the protein of SEQ No. 381 | 2df |
| SEQ ID No. 791 | ITLFLLFLNLVFGQDK | 4-19 for the protein of SEQ No. 385 | 2d |
| SEQ ID No. 792 | ITPIQEVNFADDFANNR | 174-190 for the protein of SEQ No. 447 | 2df |
| SEQ ID No. 793 | ITPIQEVNFADDLANNR | 174-190 for the protein of SEQ No. 466 | 2df |
| SEQ ID No. 794 | ITPQQEAQFAYK | 173-184 for the proteins of SEQ No. 388, 389, 390, 391, 392, 393, 394, 395, 396, 397, 398, 399, 400, 401, 402, 403, 404, 406, 407, 408, 409, 411, 412, 416, 417, 418, 419, 420, 421, 422, 423, 424, 425, 426, 427, 428, 434, 436, 437, 438, 439, 444, 445, 446, 448, 451, 452, 453, 454, 455, 456, 457, 467, 468, 472, 473, 474, 475, 478, 479, 480, 482, 483, 487, 495, 502, 503, 507, 508; 167-178 for the proteins of sequence SEQ ID No. 431, 432 | 2df |
| SEQ ID No. 795 | ITPQQEAQFTYK | 173-184 for the protein of SEQ No, 405 | 2df |
| SEQ ID No. 796 | ITPVQEVNFADDLAHNR | 174-190 for the proteins of SEQ No. 364, 365, 371, 414, 449, 506 | 2df |
| SEQ ID No. 797 | IVAFALK | 241-247 for the proteins of SEQ No. 366, 387 | 2df |
| SEQ ID No. 798 | IVAFALNMEMR | 241-251 for the proteins of SEQ No. 440, 459, 460, 461, 462, 463, 464, 465, 486, 493; 242-252 for the proteins of sequence SEQ ID No. 374, 441 | 2df |
| SEQ ID No. 799 | IVESTTLADGTVVHGK | 186-201 for the proteins of SEQ No. 496, 497, 499, 500 | 2d |

-continued

| Peptide SEQ ID No. | Amino acid sequence | Position of the peptide in the OXA protein(s) | Clinical interest |
|---|---|---|---|
| SEQ ID No. 800 | IYNSLIGLNEK | 74-84 for the proteins of SEQ No. 386, 429, 430, 477 | 2d |
| SEQ ID No. 801 | KPDIGWWVGWIER | 237-249 for the protein of SEQ No. 382 | 2df |
| SEQ ID No. 802 | LACATNNLAR | 50-59 for the protein of SEQ No. 490 | 2d |
| SEQ ID No. 803 | LAQGELPFPAPVQSTVR | 172-188 for the protein of SEQ No. 380 | 2d |
| SEQ ID No. 804 | LAQNELPYPIEIQK | 177-190 for the proteins of SEQ No. 429, 430, 477 | 2d |
| SEQ ID No. 805 | LAQNELQYPIEIQK | 176-189 for the protein of SEQ No. 386 | 2d |
| SEQ ID No. 806 | LDFGNK | 143-148 for the proteins of SEQ No. 429, 430, 477; 142-147 for the protein of sequence SEQ ID No. 386 | 2d |
| SEQ ID No. 807 | LDGSLNR | 206-212 for the protein of SEQ No. 347 | 2d |
| SEQ ID No. 808 | LEIGK | 244-248 for the protein of SEQ No. 349 | 2d |
| SEQ ID No. 809 | LEILQQALAELGLYPK | 255-270 for the protein of SEQ No. 469 | 2df |
| SEQ ID No. 810 | LENQEQVK | 173-180 for the protein of SEQ No. 377 | 2d |
| SEQ ID No. 811 | LETQEEVEK | 195-203 for the protein of SEQ No. 364 | 2df |
| SEQ ID No. 812 | LETQEEVK | 195-202 for the proteins of SEQ No, 365, 371, 414, 447, 449, 466, 506 | 2df |
| SEQ ID No. 813 | LFAAEGVK | 55-62 for the protein of SEQ No. 382 | 2df |
| SEQ ID No. 814 | LFESAGVK | 58-65 for the protein of SEQ No. 381 | 2df |
| SEQ ID No. 815 | LFGAAGVK | 30-37 for the protein of SEQ No. 380 | 2d |
| SEQ ID No. 816 | LFPEWEK | 110-116 for the proteins of SEQ No. 388, 389, 390, 391, 392, 393, 394, 395, 396, 397, 398, 399, 400, 401, 402, 403, 404, 405, 406, 407, 408, 409, 411, 412, 416, 417, 418, 419, 420, 421, 422, 423, 424, 425, 426, 427, 428, 434, 436, 437, 438, 439, 444, 445, 446, 448, 451, 452, 453, 454, 455, 456, 457, 467, 468, 472, 473, 474, 475, 478, 479, 480, 482, 483, 487, 495, 502, 503, 507, 508; 104-110 for the proteins of sequence SEQ ID No. 431, 432 | 2df |
| SEQ ID No. 817 | LGESR | 126-130 for the protein of SEQ No. 351 | 2de |
| SEQ ID No. 818 | LGVDR | 121-125 for the protein of SEQ No. 349 | 2d |
| SEQ ID No. 819 | LHVSER | 181-186 for the proteins of SEQ No. 378, 384, 450, 476, 485 | 2df |
| SEQ ID No. 820 | LHYGNAK | 131-137 for the protein of SEQ No. 385 | 2d |
| SEQ ID No. 821 | LLNLLSQSK | 160-168 for the protein of SEQ No. 377 | 2d |

-continued

| Peptide SEQ ID No. | Amino acid sequence | Position of the peptide in the OXA protein(s) | Clinical interest |
|---|---|---|---|
| SEQ ID No. 822 | LLQDER | 243-248 for the protein of SEQ No, 433 | 2d |
| SEQ ID No. 823 | LLVQDGDCGR | 38-47 for the proteins of SEQ No. 496, 497, 499, 500 | 2d |
| SEQ ID No. 824 | LNEVGYGNR | 160-168 for the protein of SEQ No. 382 | 2df |
| SEQ ID No. 825 | LNYGNADPSTK | 144-154 for the proteins of SEQ No. 355, 363 | 2d |
| SEQ ID No. 826 | LNYGNK | 130-135 for the protein of SEQ No. 377 | 2d |
| SEQ ID No. 827 | LPASK | 178-182 for the proteins of SEQ No. 489, 505; 172-176 for the protein of sequence SEQ ID No. 498 | 2d |
| SEQ ID No. 828 | LPHTLFALDADAVR | 76-89 for the proteins of SEQ No. 369, 372 | OXA |
| SEQ ID No. 829 | LPHTLFALDAGAVR | 76-89 for the protein of SEQ No. 484 | OXA |
| SEQ ID No. 830 | LPLAIMGFDSGILQSPK | 62-78 for the protein of SEQ No. 349 | 2d |
| SEQ ID No. 831 | LPLAIMGYDADILLDATTPR | 69-88 for the protein of SEQ No. 351 | 2de |
| SEQ ID No. 832 | LPSSLIALETGAVR | 98-111 for the protein of SEQ No. 381 | 2df |
| SEQ ID No. 833 | LPVSAQTLQYTANILK | 170-185 for the protein of SEQ No. 347 | 2d |
| SEQ ID No. 834 | LPVSER | 205-210 for the protein of SEQ No. 381 | 2df |
| SEQ ID No. 835 | LPVSPTAVDMTER | 173-185 for the proteins of SEQ No. 496, 497, 499, 500 | 2d |
| SEQ ID No. 836 | LSASK | 178-182 for the proteins of SEQ No. 352, 357, 358, 359, 368, 383, 435, 442, 471, 492, 501, 504; 169-173 for the proteins of sequence SEQ ID No. 348, 353, 354; 179-183 for the protein of sequence SEQ ID No. 490 | OXA |
| SEQ ID No. 837 | LSAVPIYQEVAR | 121-132 for the protein of SEQ No. 379 | 2df |
| SEQ ID No. 838 | LSAVPVYQELAR | 127-138 for the proteins of SEQ No. 364, 365, 371, 414, 447, 449, 506; 125-136 for the proteins of sequence SEQ ID No. 366, 374, 387, 440, 441, 459, 460, 461, 462, 463, 464, 465, 486, 493 | 2df |
| SEQ ID No. 839 | LSCTLVIDEASGDLLHR | 37-53 for the protein of SEQ No. 351 | 2de |
| SEQ ID No. 840 | LSLQHGWFIGWIEK | 211-224 for the protein of SEQ No. 494 | 2de |
| SEQ ID No. 841 | LSQNSLPFSQEAMNSVK | 164-180 for the protein of SEQ No. 385 | 2d |
| SEQ ID No. 842 | LSVNPK | 168-173 for the protein of SEQ No. 494 | 2de |
| SEQ ID No. 843 | LTQDER | 239-244 for the proteins of SEQ No. 496, 497, 499, 500 | 2d |

-continued

| Peptide SEQ ID No. | Amino acid sequence | Position of the peptide in the OXA protein(s) | Clinical interest |
|---|---|---|---|
| SEQ ID No. 844 | LTVGAR | 245-250 for the protein of SEQ No. 351 | 2de |
| SEQ ID No. 845 | LYGFALNIDMPGGEADIGK | 228-246 for the protein of SEQ No. 380 | 2d |
| SEQ ID No. 846 | LYHNELPFR | 178-186 for the proteins of SEQ No. 356, 491 | 2d |
| SEQ ID No. 847 | LYHNK | 176-180 for the proteins of SEQ No. 378, 384, 450, 476, 485 | 2df |
| SEQ ID No. 848 | LYQNDLPFR | 178-186 for the protein of SEQ No. 375 | 2d |
| SEQ ID No. 849 | MDDLFK | 243-248 for the proteins of SEQ No. 350, 356, 367, 370, 375, 415, 443, 481, 488, 491; 232-237 for the protein of sequence SEQ ID No. 362 | OXA |
| SEQ ID No. 850 | MEDLHK | 243-248 for the proteins of SEQ No. 355, 363 | 2d |
| SEQ ID No. 851 | MLIALIGLENHK | 85-96 for the protein of SEQ No. 506 | 2df |
| SEQ ID No. 852 | MLLIEQQGDAALYAK | 198-212 for the protein of SEQ No. 379 | 2df |
| SEQ ID No. 853 | MLLIK | 204-208 for the proteins of SEQ No. 364, 365, 371, 414, 447, 449, 466, 506 | 2df |
| SEQ ID No. 854 | MLNALIGLEHHK | 84-95 for the proteins of SEQ No. 388, 389, 390, 391, 392, 393, 394, 395, 396, 397, 398, 399, 400, 401, 402, 403, 404, 405, 406, 408, 409, 411, 412, 416, 417, 418, 419, 420, 421, 422, 423, 424, 425, 426, 427, 428, 434, 436, 437, 438, 439, 444, 445, 446, 448, 451, 452, 453, 454, 455, 456, 457, 467, 468, 472, 473, 474, 475, 478, 479, 480, 482, 487, 495, 502, 503, 507, 508; 78-89 for the proteins of sequence SEQ ID No. 431, 432 | 2df |
| SEQ ID No. 855 | MLNALIGLENHK | 85-96 for the proteins of SEQ No. 364, 365, 371, 414, 447, 449, 466 | 2df |
| SEQ ID No. 856 | MLNALIGLENQK | 83-94 for the proteins of SEQ No. 366, 374, 387, 440, 441, 459, 460, 461, 462, 463, 464, 465, 486, 493 | 2df |
| SEQ ID No. 857 | MLNALIGLEYHK | 84-95 for the protein of SEQ No. 483 | 2df |
| SEQ ID No. 858 | MLNALIGLQHGK | 78-89 for the protein of SEQ No. 469 | 2df |
| SEQ ID No. 859 | MLNALISLEHHK | 84-95 for the protein of SEQ No. 407 | 2df |
| SEQ ID No. 860 | MQAYVDAFDYGNR | 139-151 for the protein of SEQ No. 379 | 2df |
| SEQ ID No. 861 | MQEGLNK | 123-129 for the protein of SEQ No. 377 | 2d |
| SEQ ID No. 862 | MSPASTYK | 87-94 for the protein of SEQ No. 382 | 2df |
| SEQ ID No. 863 | MTAGGK | 234-239 for the protein of SEQ No. 498 | 2d |
| SEQ ID No. 864 | MVSGK | 165-169 for the protein of SEQ No. 347 | 2d |

| Peptide SEQ ID No. | Amino acid sequence | Position of the peptide in the OXA protein(s) | Clinical interest |
|---|---|---|---|
| SEQ ID No. 865 | NEHDPVLPYR | 71-80 for the proteins of SEQ No. 496, 497, 499, 500 | 2d |
| SEQ ID No. 866 | NEHQIFK | 86-92 for the protein of SEQ No. 490; 85-91 for the protein of sequence SEQ ID No. 383 | 2d |
| SEQ ID No. 867 | NEHQVFK | 85-91 for the proteins of SEQ No. 352, 357, 358, 359, 368, 435, 442, 471, 492, 501, 504; 76-82 for the proteins of sequence SEQ ID No. 348, 353, 354 | OXA |
| SEQ ID No. 868 | NEITYK | 262-267 for the proteins of SEQ No. 364, 365, 371, 414, 447, 449, 466, 506 | 2df |
| SEQ ID No. 869 | NELLMK | 260-265 for the proteins of SEQ No. 366, 387, 440, 459, 460, 462, 463, 464, 465, 486, 493; 261-266 for the proteins of sequence SEQ ID No. 374, 441 | 2df |
| SEQ ID No. 870 | NELMMK | 260-265 for the protein of SEQ No. 461 | 2df |
| SEQ ID No. 871 | NELPFR | 181-186 for the proteins of SEQ No. 350, 355, 356, 363, 367, 370, 415, 443, 481, 488, 491; 170-175 for the protein of sequence SEQ ID No. 362 | OXA |
| SEQ ID No. 872 | NFILIFIFVILISCK | 5-19 for the proteins of SEQ No. 386, 429, 477 | 2d |
| SEQ ID No. 873 | NFILIFIFVILTSCK | 5-19 for the protein of SEQ No. 430 | 2d |
| SEQ ID No. 874 | NISSYGNNLVR | 62-72 for the protein of SEQ No. 466 | 2df |
| SEQ ID No. 875 | NISTYGNNLTR | 62-72 for the protein of SEQ No. 447 | 2df |
| SEQ ID No. 876 | NLFNEVHTTGVLVIR | 43-57 for the protein of SEQ No, 412 | 2df |
| SEQ ID No. 877 | NLSTYGNALAR | 62-72 for the proteins of SEQ No. 364, 365, 371, 414, 449, 506 | 2df |
| SEQ ID No. 878 | NMENLELFGK | 187-196 for the protein of SEQ No. 385 | 2d |
| SEQ ID No. 879 | NMLLLEENNGYK | 201-212 for the protein of SEQ No. 440 | 2df |
| SEQ ID No. 880 | NMLLLEESNGYK | 201-212 for the proteins of SEQ No. 366, 374, 387, 441, 459, 460, 461, 462, 463, 465, 486, 493 | 2df |
| SEQ ID No. 881 | NMLLLEK | 201-207 for the protein of SEQ No. 464 | 2df |
| SEQ ID No. 882 | NMTLGDAMK | 117-125 for the proteins of SEQ No. 388, 392, 393, 396, 397, 402, 405, 406, 416, 419, 422, 424, 434, 445, 446, 448, 475, 503; 111-119 for the proteins of sequence SEQ ID No. 431, 432 | 2df |
| SEQ ID No. 883 | NNGLTEAWLESSLK | 156-169 for the proteins of SEQ No. 360, 376; 141-154 for the protein of sequence SEQ ID No. 361 | 2d |
| SEQ ID No. 884 | NQLPFK | 181-186 for the protein of SEQ No. 373 | 2d |
| SEQ ID No. 885 | NQLPFQVEHQR | 181-191 for the proteins of SEQ No. 369, 372, 484 | OXA |

-continued

| Peptide SEQ ID No. | Amino acid sequence | Position of the peptide in the OXA protein(s) | Clinical interest |
|---|---|---|---|
| SEQ ID No. 886 | NSAIENTIDNMYLQDLENSTK | 191-211 for the protein of SEQ No. 376 | 2d |
| SEQ ID No. 887 | NSAIENTIENMYLQDLDNSTK | 191-211 for the protein of SEQ No. 360 | 2d |
| SEQ ID No. 888 | NSAIENTIENMYLQDLENSTK | 176-196 for the protein of SEQ No. 361 | 2d |
| SEQ ID No. 889 | NSAVWVYELFAK | 119-130 for the proteins of SEQ No. 369, 372, 484 | OXA |
| SEQ ID No. 890 | NSQVPAYK | 118-125 for the proteins of SEQ No, 429, 430, 477; 117-124 for the protein of sequence SEQ ID No. 386 | 2d |
| SEQ ID No. 891 | NSTVWIYELFAK | 119-130 for the proteins of SEQ No. 356, 491 | 2d |
| SEQ ID No. 892 | NSTVWVYELFAK | 119-130 for the proteins of SEQ No. 350, 367, 370, 373, 375, 415, 443, 481, 488; 108-119 for the protein of sequence SEQ ID No. 362 | OXA |
| SEQ ID No. 893 | NSTVWVYQLFAK | 119-130 for the proteins of SEQ No. 355, 363 | 2d |
| SEQ ID No. 894 | NTSGALVIQTDK | 48-59 for the protein of SEQ No. 460 | 2df |
| SEQ ID No. 895 | NTSGVLVIQTDK | 48-59 for the proteins of SEQ No. 366, 374, 387, 440, 441, 459, 461, 462, 463, 464, 465, 486, 493 | 2df |
| SEQ ID No. 896 | NVDEMFYYYDGSK | 75-87 for the protein of SEQ No. 377 | 2d |
| SEQ ID No. 897 | NWILR | 204-208 for the proteins of SEQ No. 350, 356, 367, 369, 370, 372, 375, 415, 443, 481, 484, 488, 491; 193-197 for the protein of sequence SEQ ID No. 362 | OXA |
| SEQ ID No. 898 | NWNAAMDLR | 125-133 for the protein of SEQ No. 382 | 2df |
| SEQ ID No. 899 | NYVDAFHYGNQDISGDK | 118-134 for the protein of SEQ No. 494 | 2de |
| SEQ ID No. 900 | QADHAILVFDQAR | 51-63 for the protein of SEQ No. 375 | 2d |
| SEQ ID No. 901 | QAEHALLVFGQER | 51-63 for the proteins of SEQ No. 369, 372, 484 | OXA |
| SEQ ID No. 902 | QAITK | 251-255 for the proteins of SEQ No. 378, 384, 450, 485; 247-251 for the protein of sequence SEQ ID No. 476 | 2df |
| SEQ ID No. 903 | QAMLTEANSDYIIR | 193-206 for the protein of SEQ No. 384 | 2df |
| SEQ ID No. 904 | QEVQFVSALAR | 171-181 for the protein of SEQ No. 469 | 2df |
| SEQ ID No. 905 | QFASIK | 243-248 for the protein of SEQ No. 347 | 2d |
| SEQ ID No. 906 | QGMPGSIR | 254-261 for the protein of SEQ No. 447 | 2df |
| SEQ ID No. 907 | QGMSGSIR | 254-261 for the protein of SEQ No. 466 | 2df |
| SEQ ID No. 908 | QGQTQQSYGNDLAR | 58-71 for the proteins of SEQ No. 388, 389, 390, 391, 392, 393, 394, 395, 396, 397, 398, | 2df |

| Peptide SEQ ID No. | Amino acid sequence | Position of the peptide in the OXA protein(s) | Clinical interest |
|---|---|---|---|
| | | 399, 400, 401, 402, 403, 404, 405, 406, 407, 408, 409, 411, 412, 416, 417, 418, 419, 420, 421, 422, 423, 424, 425, 426, 427, 428, 436, 437, 438, 439, 444, 445, 446, 448, 451, 452, 453, 454, 455, 456, 457, 467, 468, 472, 473, 474, 475, 478, 479, 480, 482, 483, 487, 495, 502, 503, 507, 508; 52-65 for the proteins of sequence SEQ ID No. 431, 432 | |
| SEQ ID No. 909 | QIDYGNADPSTIK | 143-155 for the proteins of SEQ No. 369, 372, 484 | OXA |
| SEQ ID No. 910 | QIDYGNVDPSTIK | 143-155 for the protein of SEQ No. 373 | 2d |
| SEQ ID No. 911 | QIGEAR | 129-134 for the proteins of SEQ No. 378, 450, 476, 485 | 2df |
| SEQ ID No. 912 | QIGQAR | 129-134 for the protein of SEQ No. 384 | 2df |
| SEQ ID No. 913 | QIMLIEQTPAFTLR | 190-203 for the protein of SEQ No. 470 | 2df |
| SEQ ID No. 914 | QLGSAIDQFWLR | 152-163 for the protein of SEQ No. 379 | 2df |
| SEQ ID No. 915 | QLHDNK | 199-204 for the protein of SEQ No. 381 | 2df |
| SEQ ID No. 916 | QLIFVHTVVQK | 229-239 for the protein of SEQ No. 347 | 2d |
| SEQ ID No. 917 | QLIFVHTVVQKPGK | 229-242 for the protein of SEQ No. 347 | 2d |
| SEQ ID No. 918 | QLPVK | 178-182 for the protein of SEQ No. 433; 184-188 for the protein of sequence SEQ ID No. 379 | OXA |
| SEQ ID No. 919 | QLPVKPR | 184-190 for the protein of SEQ No. 379 | 2df |
| SEQ ID No. 920 | QLSLDVLDK | 265-273 for the proteins of SEQ No. 410, 413, 458 | 2df |
| SEQ ID No. 921 | QLVYAR | 237-242 for the protein of SEQ No. 433 | 2d |
| SEQ ID No. 922 | QMMLTEASTDYIIR | 217-230 for the protein of SEQ No. 381 | 2df |
| SEQ ID No. 923 | QMSIVEATPDYVLHGK | 214-229 for the protein of SEQ No. 382 | 2df |
| SEQ ID No. 924 | QPTDPAR | 99-105 for the protein of SEQ No. 433 | 2d |
| SEQ ID No. 925 | QPTDPTR | 93-99 for the proteins of SEQ No. 496, 497, 499, 500 | 2d |
| SEQ ID No. 926 | QPVSAGIR | 246-253 for the proteins of SEQ No. 496, 497, 499, 500 | 2d |
| SEQ ID No. 927 | QQLVK | 275-279 for the protein of SEQ No. 381 | 2df |
| SEQ ID No. 928 | QTLVFAR | 232-238 for the proteins of SEQ No. 496, 497, 499, 500 | 2d |
| SEQ ID No. 929 | QVGAEK | 126-131 for the protein of SEQ No. 470 | 2df |
| SEQ ID No. 930 | QVVFAR | 238-243 for the protein of SEQ No. 349 | 2d |

-continued

| Peptide SEQ ID No. | Amino acid sequence | Position of the peptide in the OXA protein(s) | Clinical interest |
|---|---|---|---|
| SEQ ID No. 931 | SADEVLPYGGK | 84-94 for the protein of SEQ No. 380 | 2d |
| SEQ ID No. 932 | SADEVLPYGGKPQR | 84-97 for the protein of SEQ No. 380 | 2d |
| SEQ ID No. 933 | SCATNDLAR | 50-58 for the proteins of SEQ No. 352, 435, 492, 501; 41-49 for the proteins of sequence SEQ ID No. 348, 353, 354 | OXA |
| SEQ ID No. 934 | SCATNNLAR | 50-58 for the proteins of SEQ No. 357, 358, 359, 368, 383, 442, 471, 504 | OXA |
| SEQ ID No. 935 | SDIPGGSK | 251-258 for the protein of SEQ No. 349 | 2d |
| SEQ ID No. 936 | SDWGK | 29-33 for the protein of SEQ No. 375 | 2d |
| SEQ ID No. 937 | SEDNPHISSQQHEK | 27-40 for the proteins of SEQ No. 364, 365, 371, 414, 449, 506 | 2df |
| SEQ ID No. 938 | SEMPASIR | 252-259 for the proteins of SEQ No. 366, 387, 440, 459, 460, 461, 462, 463, 464, 486, 493; 253-260 for the proteins of sequence SEQ ID No. 374, 441 | 2df |
| SEQ ID No. 939 | SEMPASTR | 252-259 for the protein of SEQ No. 465 | 2df |
| SEQ ID No. 940 | SFAAHNQDQDLR | 103-114 for the proteins of SEQ No. 356, 491 | 2d |
| SEQ ID No. 941 | SFAGHNK | 103-109 for the protein of SEQ No. 375 | 2d |
| SEQ ID No. 942 | SFAGHNQDQDLR | 103-114 for the proteins of SEQ No. 369, 372, 373, 484 | 2d |
| SEQ ID No. 943 | SFAGHNQDQNLR | 103-114 for the proteins of SEQ No. 355, 363 | 2d |
| SEQ ID No. 944 | SFLESWAK | 100-107 for the protein of SEQ No. 386 | 2d |
| SEQ ID No. 945 | SFTAWEK | 109-115 for the proteins of SEQ No. 366, 374, 387, 441, 459, 460, 461, 462, 463, 464, 465, 486, 493; 104-110 for the protein of sequence SEQ ID No. 469 | 2df |
| SEQ ID No. 946 | SFTTWEK | 109-115 for the protein of SEQ No. 440 | 2df |
| SEQ ID No. 947 | SGSGWLR | 207-213 for the protein of SEQ No. 349 | 2d |
| SEQ ID No. 948 | SGWGMAVDPQVGWYVGFVEK | 221-240 for the proteins of SEQ No. 410, 413, 458 | 2df |
| SEQ ID No. 949 | SGWGMDVSPQVGWLTGWVEK | 219-238 for the protein of SEQ No. 466 | 2df |
| SEQ ID No. 950 | SGWGMDVTPQVGWLTGWVEK | 219-238 for the protein of SEQ No. 447 | 2df |
| SEQ ID No. 951 | SIHPASTFK | 69-77 for the protein of SEQ No. 379 | 2df |
| SEQ ID No. 952 | SIPTK | 252-256 for the proteins of SEQ No. 352, 357, 358, 359, 368, 383, 435, 442, 471, 490, 492, 501, 504, 505; 243-247 for the proteins of sequence SEQ ID No. 348, 353, 354 | OXA |

| Peptide SEQ ID No. | Amino acid sequence | Position of the peptide in the OXA protein(s) | Clinical interest |
|---|---|---|---|
| SEQ ID No. 953 | SISTK | 252-256 for the protein of SEQ No. 489 | 2d |
| SEQ ID No. 954 | SLGLSNNLSR | 76-85 for the protein of SEQ No. 381 | 2df |
| SEQ ID No. 955 | SLSMSGK | 4-10 for the protein of SEQ No. 351 | 2de |
| SEQ ID No. 956 | SMLFIEEK | 202-209 for the proteins of SEQ No. 388, 389, 390, 391, 392, 393, 394, 395, 396, 397, 398, 399, 400, 401, 402, 403, 404, 405, 406, 407, 408, 409, 411, 416, 417, 418, 419, 420, 421, 422, 424, 425, 426, 427, 428, 434, 436, 437, 438, 439, 444, 445, 446, 451, 452, 453, 454, 455, 456, 457, 467, 468, 472, 473, 474, 475, 478, 479, 480, 482, 483, 487, 495, 502, 503, 507, 508; 196-203 for the proteins of sequence SEQ ID No. 431, 432 | 2df |
| SEQ ID No. 957 | SNGEK | 239-243 for the proteins of SEQ No. 447, 466 | 2df |
| SEQ ID No. 958 | SNGLTHSWLGSSLK | 141-154 for the protein of SEQ No. 498 | 2d |
| SEQ ID No. 959 | SNGYK | 208-212 for the proteins of SEQ No. 366, 374, 387, 441, 459, 460, 461, 462, 463, 464, 465, 486, 493 | 2df |
| SEQ ID No. 960 | SPTWELK | 79-85 for the protein of SEQ No. 349 | 2d |
| SEQ ID No. 961 | SPTWELKPEYNPSPR | 79-93 for the protein of SEQ No. 349 | 2d |
| SEQ ID No. 962 | SQDIVR | 208-213 for the protein of SEQ No. 382 | 2df |
| SEQ ID No. 963 | SQQKPTDPTIWLK | 100-112 for the protein of SEQ No. 351 | 2de |
| SEQ ID No. 964 | SQVGWLTGWVEQPDGK | 225-240 for the protein of SEQ No. 486 | 2df |
| SEQ ID No. 965 | SSSNSCTTNNAAR | 46-58 for the protein of SEQ No. 489 | 2d |
| SEQ ID No. 966 | SSSNSCTTNNATR | 46-58 for the protein of SEQ No. 505 | 2de |
| SEQ ID No. 967 | SVYGELR | 139-145 for the protein of SEQ No. 470 | 2df |
| SEQ ID No. 968 | SWILR | 204-208 for the protein of SEQ No. 373 | 2d |
| SEQ ID No. 969 | SYFDEAQTQGVIIIK | 44-58 for the proteins of SEQ No. 364, 365, 371, 414, 447, 449, 466, 506 | 2df |
| SEQ ID No. 970 | SYLEK | 139-143 for the protein of SEQ No. 355, 363 | 2d |
| SEQ ID No. 971 | SYPMWEK | 111-117 for the proteins of SEQ No. 447, 466 | 2df |
| SEQ ID No. 972 | TAYIPASTFK | 61-70 for the proteins of SEQ No. 489, 505; 77-86 for the proteins of sequence SEQ ID No. 410, 413, 458 | 2df |
| SEQ ID No. 973 | TDDLFK | 243-248 for the proteins of SEQ No. 369, 372, 373, 484 | 2d |

-continued

| Peptide SEQ ID No. | Amino acid sequence | Position of the peptide in the OXA protein(s) | Clinical interest |
|---|---|---|---|
| SEQ ID No. 974 | TDINEIFK | 95-102 for the proteins of SEQ No. 374, 387, 440, 441, 459, 460, 461, 462, 463, 464, 465, 486, 493 | 2df |
| SEQ ID No. 975 | TFIHNDPR | 51-58 for the protein of SEQ No. 470 | 2df |
| SEQ ID No. 976 | TGAGFTANR | 216-224 for the proteins of SEQ No. 360, 376; 201-209 for the protein of sequence SEQ ID No. 361 | 2d |
| SEQ ID No. 977 | TGFNDGQK | 197-204 for the protein of SEQ No. 385 | 2d |
| SEQ ID No. 978 | TGLADSK | 210-216 for the proteins of SEQ No. 429, 430; 209-215 for the protein of sequence SEQ ID No. 386 | 2d |
| SEQ ID No. 979 | TGLDLMQK | 140-147 for the protein of SEQ No, 447 | 2df |
| SEQ ID No. 980 | TGLELMQK | 140-147 for the proteins of SEQ No. 364, 365, 371, 414, 449, 506 | 2df |
| SEQ ID No. 981 | TGMGYPK | 198-204 for the protein of SEQ No. 347 | 2d |
| SEQ ID No. 982 | TGNGR | 197-201 for the protein of SEQ No. 494 | 2de |
| SEQ ID No. 983 | TGTGSFIDAR | 200-209 for the protein of SEQ No. 498 | 2d |
| SEQ ID No. 984 | TGTGSLSDAK | 211-220 for the protein of SEQ No. 351 | 2de |
| SEQ ID No. 985 | TGVATEYQPEIGWWAGWVER | 213-232 for the protein of SEQ No. 379 | 2df |
| SEQ ID No. 986 | TGVSYPLLADGTR | 202-214 for the proteins of SEQ No. 496, 497, 499, 500 | 2d |
| SEQ ID No. 987 | TGWAAMDIK | 217-225 for the proteins of SEQ No. 374, 441 | 2df |
| SEQ ID No. 988 | TGWAMDIK | 217-224 for the proteins of SEQ No. 366, 387, 440, 460, 461, 462, 463, 464, 465, 486, 493 | 2df |
| SEQ ID No. 989 | TGWAMDVK | 217-224 for the protein of SEQ No. 459 | 2df |
| SEQ ID No. 990 | TGWATR | 206-211 for the protein of SEQ No. 470 | 2df |
| SEQ ID No. 991 | TGWCFDCTPELGWWVGWVK | 205-223 for the protein of SEQ No. 380 | 2d |
| SEQ ID No. 992 | TGWEGR | 211-216 for the proteins of SEQ No. 350, 356, 367, 369, 370, 372, 373, 415, 443, 481, 484, 488, 491; 200-205 for the protein of sequence SEQ ID No. 362 | OXA |
| SEQ ID No. 993 | TGWFVDK | 230-236 for the protein of SEQ No. 382 | 2df |
| SEQ ID No. 994 | TGYDTK | 209-214 for the protein of SEQ No. 476 | 2df |
| SEQ ID No. 995 | TGYGVR | 233-238 for the protein of SEQ No. 381 | 2df |
| SEQ ID No. 996 | TGYSAR | 209-214 for the protein of SEQ No. 450 | 2df |

-continued

| Peptide SEQ ID No. | Amino acid sequence | Position of the peptide in the OXA protein(s) | Clinical interest |
|---|---|---|---|
| SEQ ID No. 997 | TGYSTR | 209-214 for the proteins of SEQ No. 378, 384, 485 | 2df |
| SEQ ID No. 998 | THESSNWGK | 25-33 for the proteins of SEQ No. 355, 363 | 2d |
| SEQ ID No. 999 | TICTAIADAGTGK | 25-37 for the proteins of SEQ No. 496, 497, 499, 500 | 2d |
| SEQ ID No. 1000 | TIGGAPDAYWVDDSLQISAR | 169-188 for the protein of SEQ No. 382 | 2df |
| SEQ ID No. 1001 | TLPFSASSYETLR | 177-189 for the protein of SEQ No. 470 | 2df |
| SEQ ID No. 1002 | TLPFSLK | 189-195 for the proteins of SEQ No. 399, 403, 411 | 2df |
| SEQ ID No. 1003 | TLPFSPK | 189-195 for the proteins of SEQ No. 389, 395, 412, 423, 428, 439, 445, 467, 482, 483, 495 | 2df |
| SEQ ID No. 1004 | TLPFSQEVQDEVQSILFIEEK | 189-209 for the protein of SEQ No. 448 | 2df |
| SEQ ID No. 1005 | TLPFSQEVQDEVQSMLFIEEK | 189-209 for the protein of SEQ No. 392, 434 | 2df |
| SEQ ID No. 1006 | TLPFSQK | 189-195 for the proteins of SEQ No. 388, 390, 391, 393, 394, 396, 397, 398, 400, 401, 402, 404, 405, 406, 407, 408, 409, 416, 417, 418, 419, 420, 421, 422, 424, 425, 426, 427, 436, 437, 438, 444, 446, 451, 452, 453, 454, 455, 456, 457, 468, 472, 473, 474, 475, 478, 480, 487, 502, 503, 507, 508; 183-189 for the proteins of sequence SEQ ID No. 431, 432 | 2df |
| SEQ ID No. 1007 | TLPSSQK | 189-195 for the protein of SEQ No. 479 | 2df |
| SEQ ID No. 1008 | TLQNGWFEGFIISK | 225-238 for the proteins of SEQ No. 360, 376; 210-223 for the protein of sequence SEQ ID No. 361 | 2d |
| SEQ ID No. 1009 | TMQEYLNK | 123-130 for the protein of SEQ No. 385 | 2d |
| SEQ ID No. 1010 | TNGNSTSVYNESR | 51-63 for the proteins of SEQ No. 355, 363 | 2d |
| SEQ ID No. 1011 | TQTYQAYDAAR | 72-82 for the protein of SEQ No. 382 | 2df |
| SEQ ID No. 1012 | TTDPTIWEK | 93-101 for the protein of SEQ No. 498 | 2d |
| SEQ ID No. 1013 | TTTTEVFK | 96-103 for the proteins of SEQ No. 395, 428 | 2df |
| SEQ ID No. 1014 | TWASNDFSR | 41-49 for the protein of SEQ No. 385 | 2d |
| SEQ ID No. 1015 | TWDMVQR | 191-197 for the protein of SEQ No. 379 | 2df |
| SEQ ID No. 1016 | TWMQFSVVWVSQEITQK | 113-129 for the proteins of SEQ No. 360, 376; 98-114 for the protein of sequence SEQ ID No. 361 | 2d |
| SEQ ID No. 1017 | TYPMWEK | 111-117 for the proteins of SEQ No. 364, 365, 371, 414, 449, 506 | 2df |
| SEQ ID No. 1018 | TYVVDPAR | 58-65 for the protein of SEQ No. 379 | 2df |

-continued

| Peptide SEQ ID No. | Amino acid sequence | Position of the peptide in the OXA protein(s) | Clinical interest |
|---|---|---|---|
| SEQ ID No. 1019 | VAFSLNIEMK | 244-253 for the protein of SEQ No. 447 | 2df |
| SEQ ID No. 1020 | VANSLIGLSTGAVR | 70-83 for the protein of SEQ No. 380 | 2d |
| SEQ ID No. 1021 | VEHQR | 187-191 for the proteins of SEQ No. 350, 355, 356, 363, 367, 369, 370, 372, 373, 375, 415, 443, 481, 484, 488, 491; 176-180 for the protein of sequence SEQ ID No. 362 | OXA |
| SEQ ID No. 1022 | VELGK | 248-252 for the protein of SEQ No. 380 | 2d |
| SEQ ID No. 1023 | VFDDAGVSGTFVLMDITADR | 38-57 for the protein of SEQ No. 379 | 2df |
| SEQ ID No. 1024 | VFLDSWAK | 88-95 for the protein of SEQ No. 377 | 2d |
| SEQ ID No. 1025 | VFLESWAK | 101-108 for the proteins of SEQ No. 429, 430, 477 | 2d |
| SEQ ID No. 1026 | VFLSSWAQDMNLSSAIK | 89-105 for the protein of SEQ No. 385 | 2d |
| SEQ ID No. 1027 | VGFER | 134-138 for the protein of SEQ No. 379 | 2df |
| SEQ ID No. 1028 | VILVFDQVR | 55-63 for the proteins of SEQ No. 356, 491 | 2d |
| SEQ ID No. 1029 | VITFTK | 228-233 for the protein of SEQ No. 494 | 2de |
| SEQ ID No. 1030 | VMAAMVR | 158-164 for the protein of SEQ No. 381 | 2df |
| SEQ ID No. 1031 | VPLAVMGYDAGILVDAHNPR | 58-77 for the protein of SEQ No. 498 | 2d |
| SEQ ID No. 1032 | VQANVK | 195-200 for the proteins of SEQ No. 366, 374, 387, 440, 441, 459, 460, 461, 462, 463, 464, 465, 486, 493 | 2df |
| SEQ ID No. 1033 | VQDEVK | 196-201 for the protein of SEQ No. 444 | 2df |
| SEQ ID No. 1034 | VQDEVQSMLFIEEK | 196-209 for the proteins of SEQ No. 388, 389, 390, 391, 392, 393, 395, 396, 397, 398, 399, 400, 401, 402, 404, 405, 406, 407, 408, 409, 411, 416, 417, 418, 419, 420, 421, 422, 424, 425, 426, 427, 428, 434, 435, 436, 437, 438, 439, 445, 446, 451, 452, 453, 454, 455, 457, 467, 468, 472, 473, 474, 475, 478, 479, 480, 482, 483, 487, 495, 502, 503, 507, 508; 190-203 for the proteins of sequence SEQ ID No. 431, 432 | 2df |
| SEQ ID No. 1035 | VQDEVQSMLFIEEMNGNK | 196-213 for the proteins of SEQ No. 412, 423 | 2df |
| SEQ ID No. 1036 | VQDGVQSMLFIEEK | 196-209 for the protein of SEQ No. 456 | 2df |
| SEQ ID No. 1037 | VQHEVQSMLFIEEK | 196-209 for the protein of SEQ No. 394 | 2df |
| SEQ ID No. 1038 | VSCLPCYQVVSHK | 138-150 for the protein of SEQ No. 382 | 2df |
| SEQ ID No. 1039 | VSCVWCYQALAR | 114-125 for the protein of SEQ No. 470 | 2df |

-continued

| Peptide SEQ ID No. | Amino acid sequence | Position of the peptide in the OXA protein(s) | Clinical interest |
|---|---|---|---|
| SEQ ID No. 1040 | VSDVCSEVTAEGWQEVR | 37-53 for the protein of SEQ No. 381 | 2df |
| SEQ ID No. 1041 | VSEVEGWQIHGK | 186-197 for the protein of SEQ No. 347 | 2d |
| SEQ ID No. 1042 | VSFSLNIEMK | 244-253 for the protein of SEQ No. 466 | 2df |
| SEQ ID No. 1043 | VSPCSSFK | 54-61 for the protein of SEQ No. 349 | 2d |
| SEQ ID No. 1044 | VSQVPAYK | 105-112 for the protein of SEQ No. 377 | 2d |
| SEQ ID No. 1045 | VVFAR | 229-233 for the protein of SEQ No. 498; 239-243 for the proteins of sequence SEQ ID No. 349, 351 | OXA |
| SEQ ID No. 1046 | WDGAK | 97-101 for the proteins of SEQ No. 355, 363 | 2d |
| SEQ ID No. 1047 | WDGEK | 104-108 for the proteins of SEQ No. 393, 402, 419, 422, 424 | 2df |
| SEQ ID No. 1048 | WDGHIYDFPDWNR | 92-104 for the protein of SEQ No. 470 | 2df |
| SEQ ID No. 1049 | WDGIK | 97-101 for the proteins of SEQ No. 356, 491 | 2d |
| SEQ ID No. 1050 | WDGKPR | 92-97 for the proteins of SEQ No. 352, 357, 358, 359, 368, 383, 435, 442, 471, 489, 492, 501, 504, 505; 83-88 for the proteins of sequence SEQ ID No. 348, 353, 354; 107-112 for the proteins of sequence SEQ ID No. 410, 413, 458; 93-98 for the protein of sequence SEQ ID No. 490; 116-121 for the protein of sequence SEQ ID No. 382; | OXA |
| SEQ ID No. 1051 | WDGQK | 104-108 for the proteins of SEQ No. 388, 389, 392, 395, 396, 397, 399, 403, 405, 406, 407, 411, 412, 423, 428, 434, 439, 445, 446, 448, 467, 468, 482, 483, 495, 503, 508; 98-102 for the proteins of sequence SEQ ID No. 431, 432 | 2df |
| SEQ ID No. 1052 | WDGQTR | 95-100 for the proteins of SEQ No. 378, 384, 450, 476, 485 | 2df |
| SEQ ID No. 1053 | WDGVK | 97-101 for the proteins of SEQ No. 369, 372, 375, 484 | 2d |
| SEQ ID No. 1054 | WDGVNR | 97-102 for the proteins of SEQ No. 350, 367, 370, 373, 415, 443, 481, 488; 86-91 for the protein of sequence SEQ ID No. 362 | OXA |
| SEQ ID No. 1055 | WDYKPEFNGYK | 78-88 for the protein of SEQ No. 498; 89-99 for the protein of sequence SEQ ID No. 351 | OXA |
| SEQ ID No. 1056 | WETYSVVWFSQQITEWLGMER | 97-117 for the protein of SEQ No. 347 | 2d |
| SEQ ID No. 1057 | WNGQK | 104-108 for the proteins of SEQ No. 394, 418, 444, 507 | 2df |
| SEQ ID No. 1058 | YAQAK | 155-159 for the protein of SEQ No. 382 | 2df |
| SEQ ID No. 1059 | YFSDFNAK | 34-41 for the proteins of SEQ No. 355, 363 | 2d |
| SEQ ID No. 1060 | YGTHLDR | 68-74 for the proteins of SEQ No. 410, 413, 458 | 2df |

-continued

| Peptide SEQ ID No. | Amino acid sequence | Position of the peptide in the OXA protein(s) | Clinical interest |
|---|---|---|---|
| SEQ ID No. 1061 | YIIHNK | 54-59 for the proteins of SEQ No. 386, 429, 430, 477 | 2d |
| SEQ ID No. 1062 | YLDELVK | 245-251 for the protein of SEQ No. 385 | 2d |
| SEQ ID No. 1063 | YLMITEAGR | 195-203 for the protein of SEQ No. 484 | OXA |
| SEQ ID No. 1064 | YLNLFSYGNANIGGGIDK | 135-152 for the proteins of SEQ No. 489, 505 | OXA |
| SEQ ID No. 1065 | YNGEK | 96-100 for the proteins of SEQ No. 429, 430, 477 | 2d |
| SEQ ID No. 1066 | YPHNPR | 88-93 for the protein of SEQ No. 494 | 2de |
| SEQ ID No. 1067 | YPVWYSQQVAHHLGAQR | 103-120 for the protein of SEQ No. 497 | 2d |
| SEQ ID No. 1068 | YSNVLAFK | 106-113 for the protein of SEQ No. 385 | 2d |
| SEQ ID No. 1069 | YSPASTFK | 68-75 for the proteins of SEQ No. 350, 355, 356, 363, 367, 369, 370, 372, 373, 375, 415, 443, 481, 484, 488, 491; 57-64 for the protein of sequence SEQ ID No. 362 | OXA |
| SEQ ID No. 1070 | YSVVPVYQQLAR | 141-152 for the protein of SEQ No. 381 | 2df |
| SEQ ID No. 1071 | YSVVWYSQLTAK | 109-120 for the protein of SEQ No. 433 | 2d |
| SEQ ID No. 1072 | YSVVWYSQQVAHHLGAQR | 103-120 for the proteins of SEQ No. 496, 499, 500 | 2d |
| SEQ ID No. 1073 | YTPASTFK | 55-62 for the protein of SEQ No. 433 | 2d |
| SEQ ID No. 1074 | YTSAFGYGNADVSGEPGK | 130-147 for the protein of SEQ No. 433 | 2d |
| SEQ ID No. 1075 | YVFVSALTGNLGSNLTSSIK | 228-247 for the protein of SEQ No. 361; 243-262 for the protein of sequence SEQ ID No. 360 | 2d |
| SEQ ID No. 1076 | YVFVSALTGSLGSNLTSSIK | 243-262 for the protein of SEQ No. 376 | 2d |
| SEQ ID No. 1077 | YVGHDR | 50-55 for the protein of SEQ No. 380 | 2d |
| SEQ ID No. 1098 | ANQAFLPASTFK | 62-73 for the proteins of SEQ No. 378, 384, 450, 476, 485 | 2df |
| SEQ ID No. 1099 | DEHQVFK | 88-94 for the proteins of SEQ No. 378, 384, 450, 476, 485 | 2df |
| SEQ ID No. 1100 | DFINLITAMK | 108-116 for the proteins of SEQ No. 378, 450, 476 | 2df |
| SEQ ID No. 1101 | DIATWNR | 101-107 for the proteins of SEQ No. 378, 450, 476 | 2df |
| SEQ ID No. 1102 | IPNSLIALDLGVVK | 74-87 for the proteins of SEQ No. 378, 384, 450, 476, 485 | 2df |
| SEQ ID No. 1103 | ISATEQISFLR | 164-174 for the proteins of SEQ No. 378, 450, 476 | 2df |
| SEQ ID No. 1104 | QAMLTEANGDYIIR | 193-206 for the proteins of SEQ No. 378, 450, 476, 485 | 2df |

-continued

| Peptide SEQ ID No. | Amino acid sequence | Position of the peptide in the OXA protein(s) | Clinical interest |
|---|---|---|---|
| SEQ ID No. 1105 | QQGFTNNLK | 52-60 for the proteins of SEQ No. 378, 384, 450, 476, 485 | 2df |
| SEQ ID No. 1106 | SQGVVVLWNENK | 40-51 for the proteins of SEQ No. 378, 450, 476, 485 | 2df |
| SEQ ID No. 1107 | SWNAHFTEHK | 30-39 for the proteins of SEQ No. 378, 450, 476, 485 | 2df |
| SEQ ID No. 1108 | VLALSAVFLVASIIGMPAVAK | 3-23 for the proteins of SEQ No. 378, 450, 476, 485 | 2df |
| SEQ ID No. 1109 | YSVVPVYQEFAR | 117-128 for the proteins of SEQ No. 378, 384, 450, 476, 485 | 2df |

In the clinical interest column, the entries 2d, 2de, 2df correspond to the functional subgroups of OXA beta-lactamases which the corresponding peptide makes it possible to detect. Therefore, the detection of a 2df peptide will indicate the presence of a carbapenemase beta-lactamase capable of hydrolysing carbapenems.

The entry 2de will indicate the presence of a beta-lactamase with an extended spectrum (ESBL) capable of hydrolysing penicillins, first-generation cephalosporins such as cephaloridine and cefalotin, and at least one antibiotic from the oxyimino-beta-lactam class such as cefotaxime, ceftazidime or monobactams such as aztreonam.

The entry OXA indicates a common peptide between at least two of the subgroups 2d, 2de and 2df. The corresponding peptide indicates the presence of an OXA beta-lactamase and the presence of a mechanism of resistance at least to penicillins and to first-generation cephalosporins.

The detection of a mechanism of resistance to carbapenems induced by an OXA protein is characterised by the detection of at least one resistance-marking carba peptide chosen from the sequences SEQ ID No. 510, 511, 512, 513, 514, 520, 521, 522, 523, 525, 527, 530, 532, 537, 541, 542, 543, 544, 545, 546, 547, 548, 549, 550, 551, 552, 556, 557, 558, 559, 560, 561, 562, 574, 579, 581, 582, 583, 584, 592, 596, 597, 598, 599, 600, 601, 602, 607, 608, 609, 628, 631, 632, 633, 635, 636, 644, 646, 647, 649, 650, 655, 656, 661, 662, 667, 674, 675, 682, 689, 690, 698, 713, 714, 719, 720, 722, 727, 729, 730, 741, 746, 748, 750, 751, 752, 755, 756, 757, 758, 763, 764, 767, 768, 772, 775, 781, 782, 790, 792, 793, 794, 795, 796, 797, 798, 801, 809, 811, 812, 813, 814, 816, 819, 824, 832, 834, 837, 838, 847, 851, 852, 853, 854, 855, 856, 857, 858, 859, 860, 862, 868, 869, 870, 874, 875, 876, 877, 879, 880, 881, 882, 894, 895, 898, 902, 903, 904, 906, 907, 908, 911, 912, 913, 914, 915, 919, 920, 922, 923, 927, 929, 937, 938, 939, 945, 946, 948, 949, 950, 951, 954, 956, 957, 959, 962, 964, 967, 969, 971, 972, 974, 975, 979, 980, 985, 988, 990, 993, 994, 995, 996, 997, 1000, 1001, 1002, 1003, 1004, 1005, 1006, 1007, 1011, 1013, 1015, 1017, 1018, 1019, 1023, 1027, 1030, 1032, 1033, 1034, 1035, 1036, 1037, 1038, 1039, 1040, 1042, 1047, 1048, 1051, 1052, 1057, 1058, 1060, 1070, 1098, 1099, 1100, 1101, 1102, 1103, 1104, 1105, 1106, 1107, 1108, 1109

Certain peptide sequences can be common to several resistance mechanisms. Therefore, the following sequences are identical:

SEQ ID No. 24 and SEQ ID No. 287

In all cases, the sequences above indicate the expression of a mechanism of resistance to penicillins, to cephalosporins, including those of the third generation such as cefotaxime/ceftazidime, to monobactams and to carbapenems.

The method of the invention and its advantages will become apparent from the rest of the present description which presents several non-limiting examples of implementation of said method.

EXAMPLE 1

Identification of Microorganisms from a Sample by Biochemical Profile

1. Culturing of the Sample on a Culture Medium

The optimum culture media and the optimum culture conditions are different according to the species of microorganism. By default, the sample is seeded on different media:

sheep blood Columbia agar (bioMérieux ref. 43041) for 18 to 24 h at 35° C., in an aerobic or anaerobic atmosphere;

TSA agar (bioMérieux ref. 43011) for 18 to 24 h at 37° C.

2. Identification of the Microorganisms

The identification is performed as follows:

1. Selection of isolated colonies
2. While maintaining the aseptic conditions, transfer of 3.0 mL of aqueous sterile saline solution (0.45-0.50% NaCl, pH 4.5 to 7.0) into a transparent plastic (polystyrene) test tube
3. With the aid of a stirrer or a sterile swab, transfer of a sufficient number of identical colonies into the saline solution tube prepared in step 2, and adjustment of the bacterial suspension between 0.50 and 0.63 McFarland with a calibrated DENSICHEK from VITEK®
4. Positioning of the bacterial suspension tube and of a VITEK® identification card on a VITEK® cartridge
5. Loading of the cartridge into the VITEK® instrument
6. The filling, sealing, incubation and reading operations are automatic
7. Acquisition of a biochemical profile
8. Identification with the VITEK® system performed by comparing to the biochemical profiles of known strains

EXAMPLE 2

Preparation of a Primary Urine Sample by Microorganism Enrichment

The following protocol is performed in 16 steps (steps 5 to 12 are optional and could be omitted if the enriched sample is subsequently treated according to examples 4 and onwards):
1. Centrifuging of 5 mL of contaminated urine, at 2000 g for 30 seconds
2. Recovery of the supernatant
3. Centrifuging at 15000 g for 5 minutes
4. Elimination of the supernatant
5. Washing of the pellet with 3 mL of distilled water by resuspension
6. Centrifuging at 15000 g for 5 minutes
7. Elimination of the supernatant
8. Place the pellet in the presence of solvent (8 acetone volumes for 1 methanol volume) for 1/10 dilution
9. Leave for 1 hour at −20° C.
10. Centrifuging at 15000 g for 5 minutes
11. Elimination of the supernatant
12. Place the pellet in the presence of solvent (8 acetone volumes for 1 methanol volume) for 1/10 dilution
13. Leave for 1 hour at −20° C.
14. Centrifuging at 15000 g for 5 minutes
15. Elimination of the supernatant
16. The pellet constitutes the microorganism-enriched sample

EXAMPLE 3

Identification of Microorganisms from a Sample by MALDI-TOF

The identification is performed as follows:
1. Transfer, with the aid of a 1 µl oese, of a portion of microorganism colony obtained according to Example 1, or of an enriched sample according to Example 2, and uniform deposition on a plate for MALDI-TOF mass spectrometry
2. Covering the deposit with 1 µl of matrix. The matrix used is a saturated solution of HCCA (alpha-cyano-4-hydroxycinnamic acid) in organic solvent (50% acetonitrile and 2.5% trifluoroacetic acid)
3. Drying at ambient temperature
4. Introducing the plate into the mass spectrometer
5. Acquiring a mass spectrum
6. Comparing the obtained spectrum with the spectra contained in a knowledge base
7. Identification of the microorganism by comparing the obtained peaks with those in the knowledge base

EXAMPLE 4

Identification of Microorganisms from a Sample by ESI-TOF

The identification is performed as follows:
1. Sampling of a microorganism colony, obtained according to Example 1, or of an enriched sample according to Example 2, and suspension in 100 µl of demineralised water.
2. Centrifuging at 3000 g for 5 minutes.
3. Elimination of the supernatant.
4. Resuspension in 100 µl of demineralised water.
5. Centrifuging at 3000 g for 5 minutes.
6. Elimination of the supernatant.
7. Resuspension in 100 µl of an acetonitrile, demineralised water and formic acid mixture (50/50/0.1%).
8. Filtration with a filter with a porosity of 0.45 µm.
9. Injection into a mass spectrometer in single MS mode.
10. Acquisition of a mass spectrum.
11. Comparing the obtained spectrum with the spectra contained in a knowledge base.
12. Identification of the microorganism by referring to reference spectra.

EXAMPLE 5

Obtaining Digested Proteins from Microorganisms

The following protocol is conventionally performed in 17 steps:
1. Sampling of a microorganism colony, obtained according to Example 1, or of an enriched sample according to Example 2, and suspension in 10 to 100 µl of a 6M guanidine hydrochloride solution, 50 mM Tris-HCl, pH=8.0.
2. Addition of dithiothreitol (DTT) to achieve an end concentration of 5 mM.
3. Reduction for 20 minutes at 95° C. in a water bath.
4. Cooling the tubes to ambient temperature.
5. Addition of iodoacetamide to obtain an end concentration of 12.5 mM.
6. Alkylation for 40 minutes at ambient temperature and in the dark.
7. Dilution by a factor of 6 with a 50 mM $NH_4HCO_3$ solution, pH=8.0 to obtain an end guanidine hydrochloride concentration of 1M.
8. Addition of 1 µg of trypsin.
9. Digestion at 37° C. for between 6 hours and one night.
10. Addition of formic acid down to a pH below 4 to stop the reaction.
11. The sample volume is made up to 1 mL with water/0.5% (v/v) formic acid
12. Balancing of the Waters Oasis HLB columns with 1 ml of methanol and then 1 ml of $H_2O$/0.1% (v/v) formic acid
13. Deposition of the sample which runs off by gravity
14. Washing with 1 ml of $H_2O$/0.1% (v/v) formic acid
15. Elution with 1 ml of a mixture of 80% methanol and 20% water/0.1% (v/v) formic acid
16. The eluate is evaporated with a SpeedVac® SPD2010 evaporator (Thermo Electron Corporation, Waltham, Mass., United States of America) over 2 hours, in order to obtain a volume of around 100 µl.
17. The eluate is then taken up in a water/0.5% (v/v) formic acid solution in a quantity sufficient for (QSF) 250 µl

EXAMPLE 6

Identification of a Resistance to NDM-1 Beta-Lactams

Samples Sam1 to Sam9 are identified according to one of the methods described in examples 1, 3 or 4. The identification of the species is set out in TABLE 1.

TABLE 1

| Names | Species |
|---|---|
| Sam1 | *K. pneumonia* |
| Sam2 | *C. freundii* |
| Sam3 | *A. baumannii* |
| Sam4 | *A. caviae* |
| Sam5 | *C. braakii* |
| Sam6 | *E. cloacae* |
| Sam7 | *P. rettgeri* |
| Sam8 | *E. coli* |
| Sam9 | *K. pneumonia* |

Samples Sam1 to Sam9 correspond to a species able to comprise an NDM-1 resistance mechanism (Enterobacteriaceae, *Pseudomonas* species, *Acinetobacter* species . . . ). The following method is then performed to search for such a mechanism.

Each sample is treated according to Example 5, then a volume of 50 µl of digested proteins is injected and analysed according to the following conditions:
  Dionex Ultimate 3000 chromatographic channel from the Dionex Corporation (Sunnyvale, United States of America).
  Waters BEH130 C18 Column, 2.1 mm inner diameter, 100 mm length, 3.5 µm particle size (Waters, Saint-Quentin En Yvelines, France).

Solvent A: $H_2O$+0.1% formic acid.
Solvent B: ACN+0.1% formic acid.
HPLC gradient defined in Table 2 hereafter:

TABLE 2

| Time (min) | Flow (µl) | Solvent A (%) | Solvent B (%) |
|---|---|---|---|
| 0 | 300 | 98 | 2 |
| 3 | 300 | 98 | 2 |
| 34 | 300 | 54.6 | 45.4 |
| 35 | 300 | 0 | 100 |
| 55 | 300 | 0 | 100 |
| 55.1 | 300 | 98 | 2 |
| 74 | 300 | 98 | 2 |

The eluate coming from the chromatographic column is directly injected into the ionising source of the QTRAP® 5500 mass spectrometer from Applied Biosystems (Foster City, United States of America).

The peptides coming from the digestion of the microorganism proteins are analysed by the mass spectrometer in MRM mode. Only the peptides indicated in TABLE 3 are detected. To this end, the fragment(s) indicated in TABLE 3 is/are detected.

TABLE 3

| Transition number | Peptide | Charge state of the precursor | Fragment ion | Retention time (minutes) | (m/z) filtered in Q1 | (m/z) filtered in Q3 | Collision energy (eV) |
|---|---|---|---|---|---|---|---|
| 1 | AAITHTAR | 2 | y4 monocharged | 5.61 | 420.74 | 484.26 | 24 |
| 2 | AAITHTAR | 2 | y5 monocharged | 5.61 | 420.74 | 585.31 | 24 |
| 3 | AAITHTAR | 2 | y6 monocharged | 5.61 | 420.74 | 698.39 | 24 |
| 4 | AFGAAFPK | 2 | y6 monocharged | 16.03 | 404.72 | 590.33 | 23 |
| 5 | AFGAAFPK | 2 | y7 monocharged | 16.03 | 404.72 | 737.4 | 23 |
| 6 | AFGAAFPK | 2 | y7 dicharged | 16.03 | 404.72 | 369.2 | 23 |
| 7 | ASMIVMSHSAPDSR | 2 | y7 monocharged | 13.65 | 744.85 | 769.36 | 38 |
| 8 | ASMIVMSHSAPDSR | 2 | y8 monocharged | 13.65 | 744.85 | 856.39 | 38 |
| 9 | ASMIVMSHSAPDSR | 2 | y9 monocharged | 13.65 | 744.85 | 987.43 | 38 |
| 10 | FGDLVFR | 2 | y4 monocharged | 19.14 | 427.23 | 534.34 | 24 |
| 11 | FGDLVFR | 2 | y5 monocharged | 19.14 | 427.23 | 649.37 | 24 |
| 12 | FGDLVFR | 2 | y6 monocharged | 19.14 | 427.23 | 706.39 | 24 |
| 13 | MELPNIMHPVAK | 2 | y10 dicharged | 19.09 | 690.36 | 560.32 | 35 |
| 14 | MELPNIMHPVAK | 2 | y9 monocharged | 19.09 | 690.36 | 1006.55 | 35 |
| 15 | MELPNIMHPVAK | 2 | y9 dicharged | 19.09 | 690.36 | 503.78 | 35 |
| 16 | QEINLPVALAWTHAHQDK | 3 | y14 dicharged | 21.34 | 695.05 | 743.41 | 39 |
| 17 | QEINLPVALAWTHAHQDK | 3 | y7 monocharged | 21.34 | 695.05 | 836.4 | 39 |
| 18 | QEINLPVALAVVTHAHQDK | 3 | y8 monocharged | 21.34 | 695.05 | 935.47 | 39 |
| 19 | SLGNLGDADTEHYAASAR | 2 | y14 dicharged | 14.64 | 924.43 | 738.84 | 46 |
| 20 | SLGNLGDADTEHYAASAR | 2 | y16 dicharged | 14.64 | 924.43 | 824.37 | 46 |
| 21 | SLGNLGDADTEHYAASAR | 2 | y7 monocharged | 14.64 | 924.43 | 775.38 | 46 |

TABLE 3-continued

| Transition number | Peptide | Charge state of the precursor | Fragment ion | Retention time (minutes) | (m/z) filtered in Q1 | (m/z) filtered in Q3 | Collision energy (eV) |
|---|---|---|---|---|---|---|---|
| 22 | VLWDTAWTDDQTAQILNWIK | 3 | y5 monocharged | 27.16 | 810.43 | 673.4 | 45 |
| 23 | VLWDTAWTDDQTAQILNWIK | 3 | y6 monocharged | 27.16 | 810.43 | 786.49 | 45 |
| 24 | VLWDTAWTDDQTAQILNWIK | 3 | y7 monocharged | 27.16 | 810.43 | 914.55 | 45 |

The precursor peptide charge state, its retention time, the fragment ion type and the transitions, i.e. the $(m/z)_1$ ratio in Q1 and $(m/z)_2$ ratio in Q3 are indicated in TABLE 3. The collision energy used to fragment the precursor ion is also indicated in TABLE 3.

The other machine parameters used are as follows:

| | |
|---|---|
| Scan type: | MRM |
| MRM planned: | yes |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 50.00 psi |
| Cone voltage: | 5500.00 V |
| Source temperature: | 500.00° C. |
| Nebulising gas: | 50.00 psi |
| Heating gas: | 40.00 psi |
| Collision gas which induces dissociation: | 9.00 psi |
| Dynamic filling: | activated |
| Declustering potential (DP): | 80.00 V |
| Entry potential before Q0 (EP): | 10.00 V |
| Collision cell exit potential (CXP): | 35 V |
| Total cycle time: | 1.2 sec |
| Detection window: | 90 sec |

The areas obtained for each of the transitions and for each of the microorganisms studied were measured. All the transitions having an area greater than or equal to 2500 (arbitrary unit) are considered to be positive and have been labelled "1" in TABLE 4. All the transitions having an area less than 2500 are considered to be negative and have been labelled 0 in TABLE 4. When no signal peak was observed, the transition has been labelled as negative.

TABLE 4

| Transition number | Sam1 | Sam2 | Sam3 | Sam4 | Sam5 | Sam6 | Sam7 | Sam8 | Sam9 |
|---|---|---|---|---|---|---|---|---|---|
| 1  | 1 | 1 | 1 | 1 | 1 | 1 | 0 | 1 | 1 |
| 2  | 1 | 1 | 1 | 1 | 1 | 1 | 1 | 1 | 1 |
| 3  | 1 | 1 | 0 | 1 | 1 | 1 | 0 | 1 | 1 |
| 4  | 1 | 1 | 1 | 1 | 1 | 1 | 1 | 1 | 1 |
| 5  | 1 | 1 | 1 | 1 | 1 | 1 | 1 | 1 | 1 |
| 6  | 1 | 1 | 0 | 1 | 1 | 1 | 1 | 1 | 1 |
| 7  | 0 | 0 | 0 | 0 | 0 | 0 | 0 | 0 | 0 |
| 8  | 0 | 0 | 0 | 0 | 0 | 0 | 0 | 0 | 0 |
| 9  | 0 | 0 | 0 | 0 | 0 | 0 | 0 | 0 | 0 |
| 10 | 1 | 1 | 1 | 1 | 1 | 1 | 1 | 1 | 1 |
| 11 | 1 | 1 | 1 | 1 | 1 | 1 | 1 | 1 | 1 |
| 12 | 1 | 1 | 1 | 1 | 1 | 1 | 1 | 1 | 1 |
| 13 | 0 | 0 | 0 | 0 | 0 | 0 | 0 | 0 | 0 |
| 14 | 0 | 0 | 0 | 0 | 0 | 0 | 0 | 0 | 0 |
| 15 | 0 | 0 | 0 | 0 | 0 | 0 | 0 | 0 | 0 |
| 16 | 1 | 1 | 0 | 1 | 1 | 0 | 0 | 0 | 1 |
| 17 | 1 | 1 | 0 | 1 | 1 | 1 | 1 | 0 | 1 |
| 18 | 1 | 1 | 0 | 1 | 1 | 0 | 1 | 0 | 1 |
| 19 | 0 | 0 | 0 | 0 | 0 | 0 | 0 | 0 | 0 |
| 20 | 0 | 0 | 0 | 0 | 0 | 0 | 0 | 0 | 0 |
| 21 | 0 | 0 | 0 | 0 | 0 | 0 | 0 | 0 | 0 |
| 22 | 0 | 0 | 0 | 0 | 0 | 0 | 0 | 0 | 0 |
| 23 | 0 | 0 | 0 | 0 | 0 | 0 | 0 | 0 | 0 |
| 24 | 0 | 0 | 0 | 0 | 0 | 0 | 0 | 0 | 0 |

The number of positive transitions is then added up and set out in TABLE 5:

TABLE 5

| Names | Species | Number of positive transitions |
|---|---|---|
| Sam1 | K. pneumoniae | 12 |
| Sam2 | C. freundii | 12 |
| Sam3 | A. baumannii | 7 |
| Sam4 | A. caviae | 12 |
| Sam5 | C. braakii | 12 |
| Sam6 | E. cloacae | 10 |
| Sam7 | P. rettgeri | 9 |
| Sam8 | E. coli | 9 |
| Sam9 | K. pneumoniae | 12 |

Samples Sam1 to Sam9 comprise more than 6 positive transitions, they therefore contain bacteria which express the NDM-1 protein. The bacteria of Sam1 to Sam9 are therefore resistant to penicillins, to cephalosporins and to carbapenems.

EXAMPLE 7

Identification of a Resistance to KPC Beta-Lactams

Samples Sam62 to Sam73 are identified according to one of the methods described in examples 1, 3 or 4. The identification of the species is set out in TABLE 6.

TABLE 6

| Names | Species |
|---|---|
| Sam62 | K. pneumoniae |
| Sam63 | K. pneumoniae |
| Sam64 | K. pneumoniae |
| Sam65 | K. pneumoniae |
| Sam66 | K. pneumoniae |
| Sam67 | K. pneumoniae |
| Sam68 | K. pneumoniae |
| Sam69 | K. pneumoniae |
| Sam70 | K. pneumoniae |
| Sam71 | K. pneumoniae |

TABLE 6-continued

| Names | Species |
|---|---|
| Sam72 | *K. pneumoniae* |
| Sam73 | *K. pneumoniae* |

Samples Sam62 to Sam73 correspond to a species able to comprise a KPC resistance mechanism. The following method is then performed to detect such a mechanism.

Each sample is treated according to Example 5, then analysed according to Example 6 by detecting the peptides from TABLE 7 instead of the peptides from TABLE 3.

TABLE 7

| Transition number | Peptide | Methionine oxidation | Charge state of the precursor | Fragment ion | Clinical interest |
|---|---|---|---|---|---|
| 1 | AAVPADWAVGDK | no | 2 | y9 dicharged | 2f |
| 2 | AAVPADWAVGDK | no | 2 | y10 dicharged | 2f |
| 3 | AAVPADWAVGDK | no | 2 | y9 monocharged | 2f |
| 4 | APIVLAVYTR | no | 2 | y7 monocharged | 2f |
| 5 | APIVLAVYTR | no | 2 | y5 monocharged | 2f |
| 6 | APIVLAVYTR | no | 2 | y6 monocharged | 2f |
| 7 | AVTESLQK | no | 2 | y5 monocharged | 2f |
| 8 | AVTESLQK | no | 2 | y6 monocharged | 2f |
| 9 | AVTESLQK | no | 2 | y4 monocharged | 2f |
| 10 | ELGGPAGLTAFMR | yes | 2 | y7 monocharged | 2f |
| 11 | ELGGPAGLTAFMR | yes | 2 | y5 monocharged | 2f |
| 12 | ELGGPAGLTAFMR | yes | 2 | y9 dicharged | 2f |
| 13 | ELGGPAGLTAFMR | no | 2 | y7 monocharged | 2f |
| 14 | ELGGPAGLTAFMR | no | 2 | y5 monocharged | 2f |
| 15 | ELGGPAGLTAFMR | no | 2 | y9 dicharged | 2f |
| 16 | FPLCSSFK | no | 2 | y6 monocharged | 2f |
| 17 | FPLCSSFK | no | 2 | y7 monocharged | 2f |
| 18 | FPLCSSFK | no | 2 | y5 monocharged | 2f |
| 19 | GFLAAAVLAR | no | 2 | y6 monocharged | 2f |
| 20 | GFLAAAVLAR | no | 2 | y7 monocharged | 2f |
| 21 | GFLAAAVLAR | no | 2 | y5 monocharged | 2f |
| 22 | GNTTGNHR | no | 2 | y5 monocharged | 2f |
| 23 | GNTTGNHR | no | 2 | y6 monocharged | 2f |
| 24 | GNTTGNHR | no | 2 | y4 monocharged | 2f |
| 25 | LALEGLGVNGQ | no | 3 | y8 monocharged | 2f |
| 26 | LALEGLGVNGQ | no | 3 | y7 monocharged | 2f |
| 27 | LALEGLGVNGQ | no | 3 | y6 monocharged | 2f |
| 28 | LTLGSALAAPQR | no | 3 | y9 monocharged | 2f |
| 29 | LTLGSALAAPQR | no | 3 | y5 monocharged | 2f |
| 30 | LTLGSALAAPQR | no | 3 | y6 monocharged | 2f |
| 31 | NALVPWSPISEK | no | 2 | y8 monocharged | 2f |
| 32 | NALVPWSPISEK | no | 2 | y8 dicharged | 2f |
| 33 | NALVPWSPISEK | no | 2 | y5 monocharged | 2f |

TABLE 7-continued

| Transition number | Peptide | Methionine oxidation | Charge state of the precursor | Fragment ion | Clinical interest |
|---|---|---|---|---|---|
| 34 | QQFVDWLK | no | 2 | y5 monocharged | 2f |
| 35 | QQFVDWLK | no | 2 | y6 monocharged | 2f |
| 36 | QQFVDWLK | no | 2 | y4 monocharged | 2f |
| 37 | SIGDTTFR | no | 2 | y5 monocharged | 2f |
| 38 | SIGDTTFR | no | 2 | y6 monocharged | 2f |
| 39 | SIGDTTFR | no | 2 | y4 monocharged | 2f |
| 40 | SQQQAGLLDTPIR | no | 2 | y8 monocharged | 2f |
| 41 | SQQQAGLLDTPIR | no | 2 | y9 monocharged | 2f |
| 42 | SQQQAGLLDTPIR | no | 2 | y10 monocharged | 2f |
| 43 | WELELNSAIPGDAR | no | 2 | y5 monocharged | 2f |
| 44 | WELELNSAIPGDAR | no | 2 | y8 monocharged | 2f |
| 45 | WELELNSAIPGDAR | no | 2 | y9 monocharged | 2f |

The transitions mentioned in TABLE 7 are detected by using the parameters set out in TABLE 8.

| Transition number | Retention time (minutes) | (m/z) filtered in Q1 | (m/z) filtered in Q3 | Collision energy (eV) | Positivity threshold |
|---|---|---|---|---|---|
| 1 | 16.29 | 600.31 | 479.73 | 31 | 2000 |
| 2 | 16.29 | 600.31 | 529.27 | 31 | 2000 |
| 3 | 16.29 | 600.31 | 958.46 | 31 | 2000 |
| 4 | 19.07 | 551.83 | 821.49 | 29 | 13000 |
| 5 | 19.07 | 551.83 | 609.33 | 29 | 13000 |
| 6 | 19.07 | 551.83 | 722.42 | 29 | 13000 |
| 7 | 10.38 | 438.25 | 604.33 | 24 | 2000 |
| 8 | 10.38 | 438.25 | 705.38 | 24 | 2000 |
| 9 | 10.38 | 438.25 | 475.29 | 24 | 2000 |
| 10 | 18.55 | 668.34 | 811.41 | 34 | 2000 |
| 11 | 18.55 | 668.34 | 641.31 | 34 | 2000 |
| 12 | 18.55 | 668.34 | 490.26 | 34 | 2000 |
| 13 | 21.72 | 660.34 | 795.42 | 34 | 2000 |
| 14 | 21.72 | 660.34 | 625.31 | 34 | 2000 |
| 15 | 21.72 | 660.34 | 482.26 | 34 | 2000 |
| 16 | 17.56 | 493.24 | 741.36 | 27 | 2000 |
| 17 | 17.56 | 493.24 | 838.41 | 27 | 2000 |
| 18 | 17.56 | 493.24 | 628.28 | 27 | 2000 |
| 19 | 20.67 | 494.8 | 600.38 | 27 | 14000 |
| 20 | 20.67 | 494.8 | 671.42 | 27 | 14000 |
| 21 | 20.67 | 494.8 | 529.35 | 27 | 14000 |
| 22 | 1.19 | 428.7 | 584.29 | 24 | 2000 |
| 23 | 1.19 | 428.7 | 685.34 | 24 | 2000 |
| 24 | 1.19 | 428.7 | 483.24 | 24 | 2000 |
| 25 | 18.89 | 535.8 | 773.38 | 42 | 2000 |
| 26 | 18.89 | 535.8 | 644.34 | 42 | 2000 |
| 27 | 18.89 | 535.8 | 587.31 | 42 | 2000 |
| 28 | 17.37 | 599.35 | 870.48 | 42 | 2000 |
| 29 | 17.37 | 599.35 | 542.3 | 42 | 2000 |
| 30 | 17.37 | 599.35 | 655.39 | 42 | 2000 |
| 31 | 20 | 670.86 | 943.49 | 35 | 2000 |
| 32 | 20 | 670.86 | 472.25 | 35 | 2000 |
| 33 | 20 | 670.86 | 573.32 | 35 | 2000 |
| 34 | 20.48 | 532.28 | 660.37 | 28 | 2000 |
| 35 | 20.48 | 532.28 | 807.44 | 28 | 2000 |
| 36 | 20.48 | 532.28 | 561.3 | 28 | 2000 |
| 37 | 13.42 | 448.73 | 639.31 | 25 | 2000 |
| 38 | 13.42 | 448.73 | 696.33 | 25 | 2000 |
| 39 | 13.42 | 448.73 | 524.28 | 25 | 2000 |
| 40 | 17.6 | 713.89 | 884.52 | 36 | 2000 |
| 41 | 17.6 | 713.89 | 955.56 | 36 | 2000 |
| 42 | 17.6 | 713.89 | 1083.62 | 36 | 2000 |
| 43 | 21.1 | 785.9 | 515.26 | 40 | 2000 |
| 44 | 21.1 | 785.9 | 786.41 | 40 | 2000 |
| 45 | 21.1 | 785.9 | 900.45 | 40 | 2000 |

The areas obtained for each of the transitions and for each of the microorganisms studied were measured. When the areas of the 3 transitions of the same peptide are greater than or equal to the positivity threshold described in TABLE 8, the detection of the peptide is considered to be positive and is labelled "1" in TABLE 9. When at least one transition comprises an area less than the positivity threshold described in TABLE 8, the corresponding peptide is considered non-detected and is labelled "0" in TABLE 9.

TABLE 9

| Transition number | Sam62 | Sam63 | Sam64 | Sam65 | Sam66 | Sam67 | Sam68 | Sam69 | Sam70 | Sam71 | Sam72 | Sam73 |
|---|---|---|---|---|---|---|---|---|---|---|---|---|
| 1 | 0 | 0 | 0 | 0 | 0 | 0 | 1 | 1 | 1 | 1 | 1 | 1 |
| 2 | 0 | 0 | 0 | 0 | 0 | 0 | 1 | 1 | 1 | 1 | 1 | 1 |
| 3 | 0 | 0 | 0 | 0 | 0 | 0 | 1 | 1 | 1 | 1 | 1 | 1 |
| 4 | 0 | 0 | 0 | 0 | 0 | 0 | 1 | 1 | 1 | 1 | 1 | 1 |

TABLE 9-continued

| Transition number | Sam62 | Sam63 | Sam64 | Sam65 | Sam66 | Sam67 | Sam68 | Sam69 | Sam70 | Sam71 | Sam72 | Sam73 |
|---|---|---|---|---|---|---|---|---|---|---|---|---|
| 5 | 0 | 0 | 0 | 0 | 0 | 0 | 1 | 1 | 1 | 1 | 1 | 1 |
| 6 | 0 | 0 | 0 | 0 | 0 | 0 | 1 | 1 | 1 | 1 | 1 | 1 |
| 7 | 0 | 0 | 0 | 0 | 0 | 0 | 0 | 0 | 0 | 0 | 0 | 0 |
| 8 | 0 | 0 | 0 | 0 | 0 | 0 | 0 | 0 | 0 | 0 | 0 | 0 |
| 9 | 0 | 0 | 0 | 0 | 0 | 0 | 0 | 0 | 0 | 0 | 0 | 0 |
| 10 | 0 | 0 | 0 | 0 | 0 | 0 | 0 | 0 | 0 | 0 | 0 | 0 |
| 11 | 0 | 0 | 0 | 0 | 0 | 0 | 0 | 0 | 0 | 0 | 0 | 0 |
| 12 | 0 | 0 | 0 | 0 | 0 | 0 | 0 | 0 | 0 | 0 | 0 | 0 |
| 13 | 0 | 0 | 0 | 0 | 0 | 0 | 1 | 1 | 1 | 1 | 1 | 1 |
| 14 | 0 | 0 | 0 | 0 | 0 | 0 | 1 | 1 | 1 | 1 | 1 | 1 |
| 15 | 0 | 0 | 0 | 0 | 0 | 0 | 1 | 1 | 1 | 1 | 1 | 1 |
| 16 | 0 | 0 | 0 | 0 | 0 | 0 | 0 | 0 | 0 | 0 | 0 | 0 |
| 17 | 0 | 0 | 0 | 0 | 0 | 0 | 0 | 0 | 0 | 0 | 0 | 0 |
| 18 | 0 | 0 | 0 | 0 | 0 | 0 | 0 | 0 | 0 | 0 | 0 | 0 |
| 19 | 0 | 0 | 0 | 0 | 0 | 0 | 1 | 1 | 1 | 1 | 1 | 1 |
| 20 | 0 | 0 | 0 | 0 | 0 | 0 | 1 | 1 | 1 | 1 | 1 | 1 |
| 21 | 0 | 0 | 0 | 0 | 0 | 0 | 1 | 1 | 1 | 1 | 1 | 1 |
| 22 | 0 | 0 | 0 | 0 | 0 | 0 | 0 | 0 | 0 | 0 | 0 | 0 |
| 23 | 0 | 0 | 0 | 0 | 0 | 0 | 0 | 0 | 0 | 0 | 0 | 0 |
| 24 | 0 | 0 | 0 | 0 | 0 | 0 | 0 | 0 | 0 | 0 | 0 | 0 |
| 25 | 0 | 0 | 0 | 0 | 0 | 0 | 0 | 0 | 0 | 0 | 0 | 0 |
| 26 | 0 | 0 | 0 | 0 | 0 | 0 | 0 | 0 | 0 | 0 | 0 | 0 |
| 27 | 0 | 0 | 0 | 0 | 0 | 0 | 0 | 0 | 0 | 0 | 0 | 0 |
| 28 | 0 | 0 | 0 | 0 | 0 | 0 | 1 | 1 | 1 | 1 | 1 | 1 |
| 29 | 0 | 0 | 0 | 0 | 0 | 0 | 1 | 1 | 1 | 1 | 1 | 1 |
| 30 | 0 | 0 | 0 | 0 | 0 | 0 | 1 | 1 | 1 | 1 | 1 | 1 |
| 31 | 0 | 0 | 0 | 0 | 0 | 0 | 1 | 1 | 1 | 1 | 1 | 1 |
| 32 | 0 | 0 | 0 | 0 | 0 | 0 | 1 | 1 | 1 | 1 | 1 | 1 |
| 33 | 0 | 0 | 0 | 0 | 0 | 0 | 1 | 1 | 1 | 1 | 1 | 1 |
| 34 | 0 | 0 | 0 | 0 | 0 | 0 | 0 | 0 | 0 | 0 | 0 | 0 |
| 35 | 0 | 0 | 0 | 0 | 0 | 0 | 0 | 0 | 0 | 0 | 0 | 0 |
| 36 | 0 | 0 | 0 | 0 | 0 | 0 | 0 | 0 | 0 | 0 | 0 | 0 |
| 37 | 0 | 0 | 0 | 0 | 0 | 0 | 1 | 1 | 1 | 1 | 1 | 1 |
| 38 | 0 | 0 | 0 | 0 | 0 | 0 | 1 | 1 | 1 | 1 | 1 | 1 |
| 39 | 0 | 0 | 0 | 0 | 0 | 0 | 0 | 0 | 0 | 0 | 0 | 0 |
| 40 | 0 | 0 | 0 | 0 | 0 | 0 | 1 | 1 | 1 | 1 | 1 | 1 |
| 41 | 0 | 0 | 0 | 0 | 0 | 0 | 1 | 1 | 1 | 1 | 1 | 1 |
| 42 | 0 | 0 | 0 | 0 | 0 | 0 | 1 | 1 | 1 | 1 | 1 | 1 |
| 43 | 0 | 0 | 0 | 0 | 0 | 0 | 0 | 0 | 0 | 0 | 0 | 0 |
| 44 | 0 | 0 | 0 | 0 | 0 | 0 | 0 | 0 | 0 | 0 | 0 | 0 |
| 45 | 0 | 0 | 0 | 0 | 0 | 0 | 0 | 0 | 0 | 0 | 0 | 0 |
| Sum of the transitions | 0 | 0 | 0 | 0 | 0 | 0 | 23 | 23 | 23 | 23 | 23 | 23 |

Samples Sam68 to Sam73 comprise at least one transition which is characteristic of KPCs. The bacteria present in samples Sam68 to Sam73 therefore express a beta-lactamase which confers on them a resistance to penicillins, to cephalosporins, including third-generation cephalosporins such as cefotaxime/ceftazidime, to monobactams and to carbapenems.

Samples Sam62 to Sam67 comprise no transition which is characteristic of KPCs. The bacteria present in samples Sam62 to Sam67 therefore do not express KPC beta-lactamase and may be sensitive to carbapenem antibiotics.

EXAMPLE 8

Identification of a Resistance to NDM-1 or KPC Beta-Lactams

The samples corresponding to a species able to comprise an NDM-1 or KPC resistance mechanism can be detected by employing the following method.

Each sample is treated according to Example 5, then analysed according to Example 6 by detecting the peptides from TABLE 10 instead of the peptides from TABLE 3.

TABLE 10

| Proteins | Transition number | Peptide | First-generation fragment ion | Charge state of the precursor | Clinical interest |
|---|---|---|---|---|---|
| NDM-1 | 1 | AAITHTAR | y4 monocharged | 2 | 3a |
| NDM-1 | 2 | AAITHTAR | y5 monocharged | 2 | 3a |
| NDM-1 | 3 | AAITHTAR | y6 monocharged | 2 | 3a |
| NDM-1 | 4 | AFGAAFPK | y6 monocharged | 2 | 3a |

TABLE 10-continued

| Proteins | Transition number | Peptide | First-generation fragment ion | Charge state of the precursor | Clinical interest |
|---|---|---|---|---|---|
| NDM-1 | 5 | AFGAAFPK | y7 monocharged | 2 | 3a |
| NDM-1 | 6 | AFGAAFPK | y7 dicharged | 2 | 3a |
| NDM-1 | 7 | FGDLVFR | y4 monocharged | 2 | 3a |
| NDM-1 | 8 | FGDLVFR | y5 monocharged | 2 | 3a |
| NDM-1 | 9 | FGDLVFR | y6 monocharged | 2 | 3a |
| NDM-1 | 10 | QEINLPVALAVVTHAHQDK | y14 dicharged | 3 | 3a |
| NDM-1 | 11 | QEINLPVALAVVTHAHQDK | y7 monocharged | 3 | 3a |
| NDM-1 | 12 | QEINLPVALAVVTHAHQDK | y8 monocharged | 3 | 3a |
| KPC | 13 | AAVPADWAVGDK | y9 dicharged | 2 | 2f |
| KPC | 14 | AAVPADWAVGDK | y10 dicharged | 2 | 2f |
| KPC | 15 | AAVPADWAVGDK | y9 monocharged | 2 | 2f |
| KPC | 16 | APIVLAVYTR | y7 monocharged | 2 | 2f |
| KPC | 17 | APIVLAVYTR | y5 monocharged | 2 | 2f |
| KPC | 18 | APIVLAVYTR | y6 monocharged | 2 | 2f |
| KPC | 19 | ELGGPAGLTAFMR | y7 monocharged | 2 | 2f |
| KPC | 20 | ELGGPAGLTAFMR | y5 monocharged | 2 | 2f |
| KPC | 21 | ELGGPAGLTAFMR | y9 dicharged | 2 | 2f |
| KPC | 22 | GFLAAAVLAR | y6 monocharged | 2 | 2f |
| KPC | 23 | GFLAAAVLAR | y7 monocharged | 2 | 2f |
| KPC | 24 | GFLAAAVLAR | y5 monocharged | 2 | 2f |
| KPC | 25 | LTLGSALAAPQR | y9 monocharged | 3 | 2f |
| KPC | 26 | LTLGSALAAPQR | y5 monocharged | 3 | 2f |
| KPC | 27 | LTLGSALAAPQR | y6 monocharged | 3 | 2f |
| KPC | 28 | NALVPWSPISEK | y8 monocharged | 2 | 2f |
| KPC | 29 | NALVPWSPISEK | y8 dicharged | 2 | 2f |
| KPC | 30 | NALVPWSPISEK | y5 monocharged | 2 | 2f |
| KPC | 31 | SQQQAGLLDTPIR | y8 monocharged | 2 | 2f |
| KPC | 32 | SQQQAGLLDTPIR | y9 monocharged | 2 | 2f |
| KPC | 33 | SQQQAGLLDTPIR | y10 monocharged | 2 | 2f |

The entry 2f indicates the presence of a carbapenemase beta-lactamase from subgroup 2f according to the Bush and Jacoby classification [Antimicrob Agents Chemother. 2010 March; 54(3):969-76. Epub 2009 Dec. 7. Updated functional classification of beta-lactamases.], capable of hydrolysing carbapenems.

The entry 3a indicates the presence of a metallo-beta-lactamase from subgroup 3a according to the Bush and Jacoby classification [9], supra, capable of hydrolysing penicillins, cephalosporins and carbapenems.

The transitions mentioned in TABLE 10 are detected by using the parameters set out in TABLE 11.

TABLE 11

| Transition number | Retention time (minutes) | (m/z) filtered in Q1 | (m/z) filtered in Q3 | Collision energy (eV) | Positivity threshold |
|---|---|---|---|---|---|
| 1 | 5.61 | 420.74 | 484.26 | 24 | 2500 |
| 2 | 5.61 | 420.74 | 585.31 | 24 | 2500 |
| 3 | 5.61 | 420.74 | 698.39 | 24 | 2500 |
| 4 | 16.03 | 404.72 | 590.33 | 23 | 2500 |
| 5 | 16.03 | 404.72 | 737.4 | 23 | 2500 |
| 6 | 16.03 | 404.72 | 369.2 | 23 | 2500 |
| 7 | 19.14 | 427.23 | 534.34 | 24 | 2500 |
| 8 | 19.14 | 427.23 | 649.37 | 24 | 2500 |

TABLE 11-continued

| Transition number | Retention time (minutes) | (m/z) filtered in Q1 | (m/z) filtered in Q3 | Collision energy (eV) | Positivity threshold |
|---|---|---|---|---|---|
| 9 | 19.14 | 427.23 | 706.39 | 24 | 2500 |
| 10 | 21.34 | 695.05 | 743.41 | 39 | 2500 |
| 11 | 21.34 | 695.05 | 836.4 | 39 | 2500 |
| 12 | 21.34 | 695.05 | 935.47 | 39 | 2500 |
| 13 | 16.29 | 600.31 | 479.73 | 31 | 2000 |
| 14 | 16.29 | 600.31 | 529.27 | 31 | 2000 |
| 15 | 16.29 | 600.31 | 958.46 | 31 | 2000 |
| 16 | 19.07 | 551.83 | 821.49 | 29 | 13000 |
| 17 | 19.07 | 551.83 | 609.33 | 29 | 13000 |
| 18 | 19.07 | 551.83 | 722.42 | 29 | 13000 |
| 19 | 21.72 | 660.34 | 795.42 | 34 | 2000 |
| 20 | 21.72 | 660.34 | 625.31 | 34 | 2000 |
| 21 | 21.72 | 660.34 | 482.26 | 34 | 2000 |
| 22 | 20.67 | 494.8 | 600.38 | 27 | 14000 |
| 23 | 20.67 | 494.8 | 671.42 | 27 | 14000 |
| 24 | 20.67 | 494.8 | 529.35 | 27 | 14000 |
| 25 | 17.37 | 599.35 | 870.48 | 42 | 2000 |
| 26 | 17.37 | 599.35 | 542.3 | 42 | 2000 |
| 27 | 17.37 | 599.35 | 655.39 | 42 | 2000 |
| 28 | 20 | 670.86 | 943.49 | 35 | 2000 |
| 29 | 20 | 670.86 | 472.25 | 35 | 2000 |
| 30 | 20 | 670.86 | 573.32 | 35 | 2000 |
| 31 | 17.6 | 713.89 | 884.52 | 36 | 2000 |
| 32 | 17.6 | 713.89 | 955.56 | 36 | 2000 |
| 33 | 17.6 | 713.89 | 1083.62 | 36 | 2000 |

When the areas of at least two transitions of the same peptide are greater than or equal to the positivity threshold described in TABLE 11, the detection of the peptide is considered to be positive. When more than two transitions of the same peptide comprise an area less than the positivity threshold described in TABLE 11, the corresponding peptide is considered non-detected.

A sample contains bacteria which express the NDM-1 protein, when at least one peptide corresponding to the NDM-1 resistance mechanism is detected. These bacteria are resistant to penicillins, to cephalosporins and to carbapenems.

A sample contains bacteria which express the KPC protein, when at least one peptide corresponding to the KPC resistance mechanism is detected. These bacteria are resistant to penicillins, to cephalosporins, including third-generation cephalosporins such as cefotaxime/ceftazidime, to monobactams and to carbapenems.

EXAMPLE 9

Identification of a Resistance to IND Beta-Lactams

Samples Sam84 to Sam88 are identified according to one of the methods described in examples 1, 3 or 4. The identification of the species is set out in TABLE 12.

TABLE 12

| Names | Species |
|---|---|
| Sam84 | C. indologenes |
| Sam85 | C. indologenes |
| Sam86 | C. indologenes |
| Sam87 | C. indologenes |
| Sam88 | C. indologenes |

Samples Sam84 to Sam88 correspond to a species able to comprise an IND resistance mechanism. The following method is then performed to detect such a mechanism.

Each sample is treated according to Example 5, then analysed according to Example 6 unless otherwise stated in the rest of the example, by detecting the peptides from TABLE 13 instead of the peptides from TABLE 3.

TABLE 13

| Transition number | Peptide | Retention time (minutes) | (m/z) filtered in Q1 | (m/z) filtered in Q3 | Declustering potential (eV) | Collision energy (eV) | Collision cell exit potential (eV) | Positivity threshold |
|---|---|---|---|---|---|---|---|---|
| 1 | AATDLGYIK | 14.66 | 476.26 | 593.37 | 65.8 | 26 | 15 | 2000 |
| 2 | AATDLGYIK | 14.66 | 476.26 | 708.39 | 65.8 | 26 | 15 | 2000 |
| 3 | AATDLGYIK | 14.66 | 476.26 | 809.44 | 65.8 | 26 | 15 | 2000 |
| 4 | AGDLSFFNNK | 18.08 | 556.77 | 522.27 | 71.7 | 29.5 | 15 | 2000 |
| 5 | AGDLSFFNNK | 18.08 | 556.77 | 669.34 | 71.7 | 29.5 | 15 | 2000 |
| 6 | AGDLSFFNNK | 18.08 | 556.77 | 756.37 | 71.7 | 29.5 | 15 | 2000 |
| 7 | AGDLSFYNK | 14.82 | 507.75 | 424.22 | 68.1 | 27.3 | 15 | 2000 |
| 8 | AGDLSFYNK | 14.84 | 507.75 | 571.29 | 68.1 | 27.3 | 15 | 2000 |
| 9 | AGDLSFYNK | 14.84 | 507.75 | 658.32 | 68.1 | 27.3 | 15 | 2000 |
| 10 | AGDLSFYNQK | 14.91 | 571.78 | 552.28 | 72.8 | 30.2 | 15 | 2000 |
| 11 | AGDLSFYNQK | 14.93 | 571.78 | 699.35 | 72.8 | 30.2 | 15 | 2000 |
| 12 | AGDLSFYNQK | 14.93 | 571.78 | 786.38 | 72.8 | 30.2 | 15 | 2000 |
| 13 | AQYQSLMDTIK | 18.01 | 649.33 | 1098.55 | 78.5 | 33.6 | 15 | 2000 |
| 14 | AQYQSLMDTIK | 18.01 | 649.33 | 607.31 | 78.5 | 33.6 | 15 | 2000 |
| 15 | AQYQSLMDTIK | 18.01 | 649.33 | 807.43 | 78.5 | 33.6 | 15 | 2000 |

TABLE 13-continued

| Transition number | Peptide | Retention time (minutes) | (m/z) filtered in Q1 | (m/z) filtered in Q3 | Declustering potential (eV) | Collision energy (eV) | Collision cell exit potential (eV) | Positivity threshold |
|---|---|---|---|---|---|---|---|---|
| 16 | ASLVIPGHDEWK | 16.84 | 676.35 | 434.70 | 80.4 | 34.8 | 15 | 2000 |
| 17 | ASLVIPGHDEWK | 16.8 | 676.35 | 868.40 | 80.4 | 34.8 | 15 | 2000 |
| 18 | ASLVIPGHDEWK | 16.82 | 676.35 | 981.48 | 80.4 | 34.8 | 15 | 2000 |
| 19 | ATLIIPGHDDWK | 17.47 | 683.36 | 427.69 | 80.9 | 35.1 | 15 | 2000 |
| 20 | ATLIIPGHDDWK | 17.47 | 683.36 | 854.38 | 80.9 | 35.1 | 15 | 2000 |
| 21 | ATLIIPGHDDWK | 17.47 | 683.36 | 967.46 | 80.9 | 35.1 | 15 | 2000 |
| 22 | ATLIIPGHDEWK | 17.54 | 690.37 | 1094.56 | 81.4 | 35.4 | 10 | 2000 |
| 23 | ATLIIPGHDEWK | 17.54 | 690.37 | 868.40 | 81.4 | 35.4 | 10 | 2000 |
| 24 | ATLIIPGHDEWK | 17.54 | 690.37 | 981.48 | 81.4 | 35.4 | 10 | 2000 |
| 25 | ATSTELIKPGK | 11.63 | 572.83 | 301.19 | 72.9 | 30.2 | 15 | 2000 |
| 26 | ATSTELIKPGK | 11.67 | 572.83 | 486.79 | 72.9 | 30.2 | 15 | 2000 |
| 27 | ATSTELIKPGK | 11.67 | 572.83 | 655.45 | 72.9 | 30.2 | 15 | 2000 |
| 28 | DFVIEPPIK | 19.93 | 529.30 | 454.30 | 69.7 | 28.3 | 15 | 2000 |
| 29 | DFVIEPPIK | 19.93 | 529.30 | 696.43 | 69.7 | 28.3 | 15 | 2000 |
| 30 | DFVIEPPIK | 19.93 | 529.30 | 795.50 | 69.7 | 28.3 | 15 | 2000 |
| 31 | DFVIEPPVKPNLYLYK | 22.03 | 645.69 | 730.91 | 78.2 | 36.3 | 15 | 2000 |
| 32 | DFVIEPPVKPNLYLYK | 22.03 | 645.69 | 787.45 | 78.2 | 36.3 | 15 | 2000 |
| 33 | DFVIEPPVKPNLYLYK | 22.08 | 645.69 | 836.99 | 78.2 | 36.3 | 15 | 2000 |
| 34 | DFVIEQPFGK | 19.77 | 590.31 | 448.26 | 74.2 | 31 | 15 | 2000 |
| 35 | DFVIEQPFGK | 19.75 | 590.31 | 705.36 | 74.2 | 31 | 15 | 2000 |
| 36 | DFVIEQPFGK | 19.75 | 590.31 | 818.44 | 74.2 | 31 | 15 | 2000 |
| 37 | EANLEQWPK | 15.53 | 557.78 | 430.25 | 71.8 | 29.5 | 15 | 2000 |
| 38 | EANLEQWPK | 15.55 | 557.78 | 558.30 | 71.8 | 29.5 | 15 | 2000 |
| 39 | EANLEQWPK | 15.55 | 557.78 | 687.35 | 71.8 | 29.5 | 15 | 2000 |
| 40 | EANVEQWPITIDK | 19.5 | 514.93 | 343.71 | 68.7 | 29.7 | 10 | 2000 |
| 41 | EANVEQWPITIDK | 19.5 | 514.93 | 686.41 | 68.7 | 29.7 | 10 | 2000 |
| 42 | EANVEQWPITIDK | 19.48 | 514.93 | 872.49 | 68.7 | 29.7 | 10 | 2000 |
| 43 | EANVEQWPK | 13.84 | 550.77 | 430.25 | 71.3 | 29.2 | 15 | 2000 |
| 44 | EANVEQWPK | 13.86 | 550.77 | 558.30 | 71.3 | 29.2 | 15 | 2000 |
| 45 | EANVEQWPK | 13.86 | 550.77 | 687.35 | 71.3 | 29.2 | 15 | 2000 |
| 46 | EQYQTLMDTIQK | 17.9 | 749.37 | 735.37 | 85.7 | 38 | 10 | 2000 |
| 47 | EQYQTLMDTIQK | 17.9 | 749.37 | 848.46 | 85.7 | 38 | 10 | 2000 |
| 48 | EQYQTLMDTIQK | 17.9 | 749.37 | 949.50 | 85.7 | 38 | 10 | 2000 |
| 49 | EYSANAVYLTTK | 15.26 | 680.34 | 1067.57 | 80.7 | 34.9 | 10 | 2000 |
| 50 | EYSANAVYLTTK | 15.28 | 680.34 | 625.36 | 80.7 | 34.9 | 10 | 2000 |
| 51 | EYSANAVYLTTK | 15.26 | 680.34 | 795.46 | 80.7 | 34.9 | 10 | 2000 |
| 52 | EYSANSMYLVTK | 16.5 | 703.34 | 1113.56 | 82.4 | 35.9 | 10 | 2000 |
| 53 | EYSANSMYLVTK | 16.5 | 703.34 | 841.45 | 82.4 | 35.9 | 10 | 2000 |

TABLE 13-continued

| Transition number | Peptide | Retention time (minutes) | (m/z) filtered in Q1 | (m/z) filtered in Q3 | Declustering potential (eV) | Collision energy (eV) | Collision cell exit potential (eV) | Positivity threshold |
|---|---|---|---|---|---|---|---|---|
| 54 | EYSANSMYLVTK | 16.5 | 703.34 | 955.49 | 82.4 | 35.9 | 10 | 2000 |
| 55 | EYSANSVYLVTK | 16.19 | 687.35 | 1081.59 | 81.2 | 35.2 | 10 | 2000 |
| 56 | EYSANSVYLVTK | 16.14 | 687.35 | 623.38 | 81.2 | 35.2 | 10 | 2000 |
| 57 | EYSANSVYLVTK | 16.12 | 687.35 | 923.52 | 81.2 | 35.2 | 10 | 2000 |
| 58 | EYSANSVYLVTQK | 16.19 | 501.26 | 376.22 | 67.7 | 29.1 | 10 | 2000 |
| 59 | EYSANSVYLVTQK | 16.19 | 501.26 | 475.29 | 67.7 | 29.1 | 10 | 2000 |
| 60 | EYSANSVYLVTQK | 16.21 | 501.26 | 751.44 | 67.7 | 29.1 | 10 | 2000 |
| 61 | EYSTNALYLVTK | 18.83 | 701.37 | 1109.62 | 82.2 | 35.9 | 10 | 2000 |
| 62 | EYSTNALYLVTK | 18.83 | 701.37 | 460.31 | 82.2 | 35.9 | 10 | 2000 |
| 63 | EYSTNALYLVTK | 18.81 | 701.37 | 623.38 | 82.2 | 35.9 | 10 | 2000 |
| 64 | GGGHVEHTLELLDK | 15.6 | 502.26 | 730.44 | 67.7 | 29.1 | 10 | 2000 |
| 65 | GGGHVEHTLELLDK | 15.6 | 502.26 | 831.48 | 67.7 | 29.1 | 10 | 2000 |
| 66 | GGGHVEHTLELLDK | 15.6 | 502.26 | 968.54 | 67.7 | 29.1 | 10 | 2000 |
| 67 | GGGHVEHTLELLNK | 15 | 501.94 | 616.37 | 67.7 | 29.1 | 10 | 2000 |
| 68 | GGGHVEHTLELLNK | 15 | 501.94 | 729.45 | 67.7 | 29.1 | 10 | 2000 |
| 69 | GGGHVEHTLELLNK | 15 | 501.94 | 830.50 | 67.7 | 29.1 | 10 | 2000 |
| 70 | GGGHVQHTLDLLDK | 15.35 | 745.39 | 1082.58 | 85.5 | 37.8 | 10 | 2000 |
| 71 | GGGHVQHTLDLLDK | 15.35 | 745.39 | 1181.65 | 85.5 | 37.8 | 10 | 2000 |
| 72 | GGGHVQHTLDLLDK | 15.35 | 745.39 | 488.31 | 85.5 | 37.8 | 10 | 2000 |
| 73 | GIPTYATAK | 12.63 | 461.26 | 376.20 | 64.7 | 25.3 | 15 | 2000 |
| 74 | GIPTYATAK | 12.63 | 461.26 | 654.35 | 64.7 | 25.3 | 15 | 2000 |
| 75 | GIPTYATAK | 12.63 | 461.26 | 751.40 | 64.7 | 25.3 | 15 | 2000 |
| 76 | GNDHVK | 1.3 | 335.17 | 383.24 | 55.6 | 19.7 | 15 | 2000 |
| 77 | GNDHVK | 1.3 | 335.17 | 498.27 | 55.6 | 19.7 | 15 | 2000 |
| 78 | GNDHVK | 1.3 | 335.17 | 612.31 | 55.6 | 19.7 | 15 | 2000 |
| 79 | GWLFDVPWEK | 23.79 | 644.86 | 559.29 | 78.1 | 33.4 | 15 | 2000 |
| 80 | GVVLFDVPWEK | 23.82 | 644.86 | 658.36 | 78.1 | 33.4 | 15 | 2000 |
| 81 | GWLFDVPWEK | 23.82 | 644.86 | 920.45 | 78.1 | 33.4 | 15 | 2000 |
| 82 | GVVLFDVPWQK | 23.32 | 644.36 | 558.30 | 78.1 | 33.4 | 15 | 2000 |
| 83 | GVVLFDVPWQK | 23.32 | 644.36 | 772.40 | 78.1 | 33.4 | 15 | 2000 |
| 84 | GVVLFDVPWQK | 23.32 | 644.36 | 919.47 | 78.1 | 33.4 | 15 | 2000 |
| 85 | HNLPVIAVFATHSHSDR | 17.94 | 634.33 | 768.90 | 77.4 | 35.7 | 15 | 2000 |
| 86 | HNLPVIAVFATHSHSDR | 17.95 | 634.33 | 825.44 | 77.4 | 35.7 | 15 | 2000 |
| 87 | HNLPVIAVFATHSHSDR | 17.93 | 634.33 | 882.46 | 77.4 | 35.7 | 15 | 2000 |
| 88 | HNLPVVAVFATHSHDDR | 17.17 | 638.99 | 775.89 | 77.7 | 35.9 | 15 | 2000 |
| 89 | HNLPVVAVFATHSHDDR | 17.17 | 638.99 | 832.43 | 77.7 | 35.9 | 15 | 2000 |
| 90 | HNLPVVAVFATHSHDDR | 17.17 | 638.99 | 889.45 | 77.7 | 35.9 | 15 | 2000 |

TABLE 13-continued

| Transition number | Peptide | Retention time (minutes) | (m/z) filtered in Q1 | (m/z) filtered in Q3 | Declustering potential (eV) | Collision energy (eV) | Collision cell exit potential (eV) | Positivity threshold |
|---|---|---|---|---|---|---|---|---|
| 91 | HTLELLDQQK | 15.02 | 612.83 | 403.23 | 75.8 | 32 | 15 | 2000 |
| 92 | HTLELLDQQK | 15.02 | 612.83 | 518.26 | 75.8 | 32 | 15 | 2000 |
| 93 | HTLELLDQQK | 15.02 | 612.83 | 986.55 | 75.8 | 32 | 15 | 2000 |
| 94 | HTLELLNK | 14.44 | 484.28 | 616.37 | 66.4 | 26.3 | 15 | 2000 |
| 95 | HTLELLNK | 14.44 | 484.28 | 729.45 | 66.4 | 26.3 | 15 | 2000 |
| 96 | HTLELLNK | 14.44 | 484.28 | 830.50 | 66.4 | 26.3 | 15 | 2000 |
| 97 | IQYQSLMDTIK | 19.41 | 670.34 | 1098.55 | 80 | 34.5 | 15 | 2000 |
| 98 | IQYQSLMDTIK | 19.38 | 670.34 | 607.31 | 80 | 34.5 | 15 | 2000 |
| 99 | IQYQSLMDTIK | 19.41 | 670.34 | 807.43 | 80 | 34.5 | 15 | 2000 |
| 100 | NLHIYK | 11.54 | 394.23 | 337.21 | 59.9 | 22.3 | 15 | 2000 |
| 101 | NLHIYK | 11.54 | 394.23 | 423.26 | 59.9 | 22.3 | 15 | 2000 |
| 102 | NLHIYK | 11.54 | 394.23 | 560.32 | 59.9 | 22.3 | 15 | 2000 |
| 103 | NLYIYK | 14.93 | 407.23 | 423.26 | 60.8 | 22.9 | 15 | 2000 |
| 104 | NLYIYK | 14.91 | 407.23 | 586.32 | 60.8 | 22.9 | 15 | 2000 |
| 105 | NLYIYK | 14.93 | 407.23 | 699.41 | 60.8 | 22.9 | 15 | 2000 |
| 106 | NNLHIYK | 11.29 | 451.25 | 423.26 | 64 | 24.9 | 15 | 2000 |
| 107 | NNLHIYK | 11.29 | 451.25 | 560.32 | 64 | 24.9 | 15 | 2000 |
| 108 | NNLHIYK | 11.27 | 451.25 | 673.40 | 64 | 24.9 | 15 | 2000 |
| 109 | QLYLYK | 15.22 | 414.24 | 423.26 | 61.3 | 23.2 | 15 | 2000 |
| 110 | QLYLYK | 15.2 | 414.24 | 586.32 | 61.3 | 23.2 | 15 | 2000 |
| 111 | QLYLYK | 15.22 | 414.24 | 699.41 | 61.3 | 23.2 | 15 | 2000 |
| 112 | QWPETMR | 14.84 | 474.22 | 317.16 | 65.7 | 25.9 | 15 | 2000 |
| 113 | QWPETMR | 14.75 | 474.22 | 407.21 | 65.7 | 25.9 | 15 | 2000 |
| 114 | QWPETMR | 14.73 | 474.22 | 633.30 | 65.7 | 25.9 | 15 | 2000 |
| 115 | SFGVFGGK | 16.69 | 399.71 | 356.20 | 60.3 | 22.6 | 15 | 2000 |
| 116 | SFGVFGGK | 16.69 | 399.71 | 408.22 | 60.3 | 22.6 | 15 | 2000 |
| 117 | SFGVFGGK | 16.69 | 399.71 | 564.31 | 60.3 | 22.6 | 15 | 2000 |
| 118 | SIQLLMMSMFLSPLINAQVK | 32.4 | 755.41 | 441.77 | 86.2 | 41.8 | 15 | 2000 |
| 119 | SIQLLMMSMFLSPLINAQVK | 32.4 | 755.41 | 882.54 | 86.2 | 41.8 | 15 | 2000 |
| 120 | SIQLLMMSMFLSPLINAQVK | 32.4 | 755.41 | 969.57 | 86.2 | 41.8 | 15 | 2000 |
| 121 | SNSATDLGYIK | 14.71 | 584.80 | 593.37 | 73.7 | 30.7 | 15 | 2000 |
| 122 | SNSATDLGYIK | 14.71 | 584.80 | 809.44 | 73.7 | 30.7 | 15 | 2000 |
| 123 | SNSATDLGYIK | 14.71 | 584.80 | 967.51 | 73.7 | 30.7 | 15 | 2000 |
| 124 | TATDLGYTGEANVK | 13.61 | 720.35 | 718.37 | 83.6 | 36.7 | 10 | 2000 |
| 125 | TATDLGYTGEANVK | 13.61 | 720.35 | 881.44 | 83.6 | 36.7 | 10 | 2000 |
| 126 | TATDLGYTGEANVK | 13.61 | 720.35 | 938.46 | 83.6 | 36.7 | 10 | 2000 |
| 127 | TFGVFDGK | 16.56 | 435.72 | 466.23 | 62.9 | 24.2 | 15 | 2000 |
| 128 | TFGVFDGK | 16.58 | 435.72 | 622.32 | 62.9 | 24.2 | 15 | 2000 |

TABLE 13-continued

| Transition number | Peptide | Retention time (minutes) | (m/z) filtered in Q1 | (m/z) filtered in Q3 | Declustering potential (eV) | Collision energy (eV) | Collision cell exit potential (eV) | Positivity threshold |
|---|---|---|---|---|---|---|---|---|
| 129 | TFGVFDGK | 16.58 | 435.72 | 769.39 | 62.9 | 24.2 | 15 | 2000 |
| 130 | TFGVFGGK | 16.78 | 406.72 | 408.22 | 60.8 | 22.9 | 15 | 2000 |
| 131 | TFGVFGGK | 16.76 | 406.72 | 564.31 | 60.8 | 22.9 | 15 | 2000 |
| 132 | TFGVFGGK | 16.78 | 406.72 | 711.38 | 60.8 | 22.9 | 15 | 2000 |
| 133 | TGKPYK | 1.41 | 347.20 | 407.23 | 56.4 | 20.3 | 15 | 2000 |
| 134 | TGKPYK | 1.41 | 347.20 | 535.32 | 56.4 | 20.3 | 15 | 2000 |
| 135 | TGKPYK | 1.41 | 347.20 | 592.35 | 56.4 | 20.3 | 15 | 2000 |
| 136 | TGKPYR | 1.41 | 361.20 | 435.24 | 57.4 | 20.9 | 15 | 2000 |
| 137 | TGKPYR | 1.41 | 361.20 | 563.33 | 57.4 | 20.9 | 15 | 2000 |
| 138 | TGKPYR | 1.41 | 361.20 | 620.35 | 57.4 | 20.9 | 15 | 2000 |
| 139 | TGVVLFDVPWEK | 24.03 | 695.37 | 1033.54 | 81.8 | 35.6 | 10 | 2000 |
| 140 | TGVVLFDVPWEK | 23.97 | 695.37 | 559.29 | 81.8 | 35.6 | 10 | 2000 |
| 141 | TGVVLFDVPWEK | 23.97 | 695.37 | 920.45 | 81.8 | 35.6 | 10 | 2000 |
| 142 | TNEFLK | 12.85 | 376.20 | 407.27 | 58.5 | 21.6 | 15 | 2000 |
| 143 | TNEFLK | 12.88 | 376.20 | 536.31 | 58.5 | 21.6 | 15 | 2000 |
| 144 | TNEFLK | 12.85 | 376.20 | 650.35 | 58.5 | 21.6 | 15 | 2000 |
| 145 | TNELLK | 11.69 | 359.21 | 373.28 | 57.3 | 20.8 | 15 | 2000 |
| 146 | TNELLK | 11.72 | 359.21 | 502.32 | 57.3 | 20.8 | 15 | 2000 |
| 147 | TNELLK | 11.69 | 359.21 | 616.37 | 57.3 | 20.8 | 15 | 2000 |
| 148 | TNQFLK | 12.3 | 375.71 | 407.27 | 58.5 | 21.5 | 15 | 2000 |
| 149 | TNQFLK | 12.27 | 375.71 | 535.32 | 58.5 | 21.5 | 15 | 2000 |
| 150 | TNQFLK | 12.27 | 375.71 | 649.37 | 58.5 | 21.5 | 15 | 2000 |
| 151 | TQYQSLMDTIK | 18.12 | 664.33 | 1098.55 | 79.5 | 34.2 | 15 | 2000 |
| 152 | TQYQSLMDTIK | 18.1 | 664.33 | 607.31 | 79.5 | 34.2 | 15 | 2000 |
| 153 | TQYQSLMDTIK | 18.12 | 664.33 | 807.43 | 79.5 | 34.2 | 15 | 2000 |
| 154 | TYATAK | 1.9 | 327.68 | 319.20 | 55 | 19.4 | 15 | 2000 |
| 155 | TYATAK | 1.85 | 327.68 | 390.24 | 55 | 19.4 | 15 | 2000 |
| 156 | TYATAK | 1.9 | 327.68 | 553.30 | 55 | 19.4 | 15 | 2000 |
| 157 | TYATPK | 7.79 | 340.68 | 345.21 | 56 | 20 | 15 | 2000 |
| 158 | TYATPK | 7.77 | 340.68 | 416.25 | 56 | 20 | 15 | 2000 |
| 159 | TYATPK | 7.79 | 340.68 | 579.31 | 56 | 20 | 15 | 2000 |
| 160 | TYATSK | 1.45 | 335.67 | 335.19 | 55.6 | 19.8 | 15 | 2000 |
| 161 | TYATSK | 1.45 | 335.67 | 406.23 | 55.6 | 19.8 | 15 | 2000 |
| 162 | TYATSK | 1.47 | 335.67 | 569.29 | 55.6 | 19.8 | 15 | 2000 |
| 163 | VIPGHDEWK | 12.43 | 540.78 | 434.70 | 70.5 | 28.8 | 15 | 2000 |
| 164 | VIPGHDEWK | 12.45 | 540.78 | 771.34 | 70.5 | 28.8 | 15 | 2000 |
| 165 | VIPGHDEWK | 12.43 | 540.78 | 868.40 | 70.5 | 28.8 | 15 | 2000 |

TABLE 13-continued

| Transition number | Peptide | Retention time (minutes) | (m/z) filtered in Q1 | (m/z) filtered in Q3 | Declustering potential (eV) | Collision energy (eV) | Collision cell exit potential (eV) | Positivity threshold |
|---|---|---|---|---|---|---|---|---|
| 166 | VLDGGCLVK | 14.44 | 480.76 | 633.34 | 66.2 | 26.2 | 15 | 2000 |
| 167 | VLDGGCLVK | 14.44 | 480.76 | 748.37 | 66.2 | 26.2 | 15 | 2000 |
| 168 | VLDGGCLVK | 14.46 | 480.76 | 861.45 | 66.2 | 26.2 | 15 | 2000 |
| 169 | VQYQSLMDTIQK | 18.24 | 727.37 | 1063.55 | 84.1 | 37 | 10 | 2000 |
| 170 | VQYQSLMDTIQK | 18.24 | 727.37 | 1226.61 | 84.1 | 37 | 10 | 2000 |
| 171 | VQYQSLMDTIQK | 18.24 | 727.37 | 935.49 | 84.1 | 37 | 10 | 2000 |
| 172 | YAQATLVIPGHDEWK | 18.03 | 576.63 | 577.26 | 73.2 | 32.8 | 10 | 2000 |
| 173 | YAQATLVIPGHDEWK | 18.03 | 576.63 | 747.39 | 73.2 | 32.8 | 10 | 2000 |
| 174 | YAQATLVIPGHDEWK | 18.05 | 576.63 | 868.40 | 73.2 | 32.8 | 10 | 2000 |
| 175 | YAQATLVIPGHEEWK | 17.99 | 581.30 | 690.37 | 73.5 | 33.1 | 10 | 2000 |
| 176 | YAQATLVIPGHEEWK | 17.95 | 581.30 | 754.40 | 73.5 | 33.1 | 10 | 2000 |
| 177 | YAQATLVIPGHEEWK | 17.97 | 581.30 | 882.41 | 73.5 | 33.1 | 10 | 2000 |
| 178 | YNVLDGGCLVK | 17.86 | 619.32 | 633.34 | 76.3 | 32.2 | 15 | 2000 |
| 179 | YNVLDGGCLVK | 17.86 | 619.32 | 748.37 | 76.3 | 32.2 | 15 | 2000 |
| 180 | YNVLDGGCLVK | 17.86 | 619.32 | 861.45 | 76.3 | 32.2 | 15 | 2000 |
| 181 | YPSTAK | 4.3 | 333.68 | 319.20 | 55.4 | 19.7 | 15 | 2000 |
| 182 | YPSTAK | 4.44 | 333.68 | 406.23 | 55.4 | 19.7 | 15 | 2000 |
| 183 | YPSTAK | 4.28 | 333.68 | 503.28 | 55.4 | 19.7 | 15 | 2000 |
| 184 | YSEAVLIIPGHDEWK | 19.76 | 586.30 | 753.90 | 73.9 | 33.3 | 15 | 2000 |
| 185 | YSEAVLIIPGHDEWK | 19.72 | 586.30 | 797.42 | 73.9 | 33.3 | 15 | 2000 |
| 186 | YSEAVLIIPGHDEWK | 19.72 | 586.30 | 868.40 | 73.9 | 33.3 | 15 | 2000 |

The other machine parameters used are as follows:

| | |
|---|---|
| Scan type: | MRM |
| MRM planned: | no |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 40.00 psi |
| Cone voltage: | 5500.00 V |
| Source temperature: | 500.00° C. |
| Nebulising gas: | 50.00 psi |
| Heating gas: | 50.00 psi |
| Collision gas which induces dissociation: | 9.00 psi |
| Dynamic filling: | activated |
| Entry potential before Q0 (EP): | 10.00 V |

The areas obtained for each of the transitions and for each of the microorganisms studied were measured. When the areas of the transitions are greater than or equal to the positivity threshold described in TABLE 13, the detection of the transition is considered to be positive and is labelled "1" in TABLE 14. When a transition has an area less than the positivity threshold described in TABLE 13, the transition is considered non-detected and is labelled "0" in TABLE 14.

For a given peptide, when at least 3 transitions are labelled "1", the peptide is considered as being detected.

TABLE 14

| Transition number | Sam84 | Sam85 | Sam86 | Sam87 | Sam88 |
|---|---|---|---|---|---|
| 1 | 0 | 1 | 1 | 1 | 1 |
| 2 | 0 | 0 | 1 | 1 | 0 |
| 3 | 0 | 0 | 0 | 1 | 0 |
| 4 | 0 | 0 | 0 | 0 | 0 |
| 5 | 0 | 0 | 0 | 0 | 0 |
| 6 | 0 | 0 | 0 | 0 | 0 |
| 7 | 0 | 0 | 0 | 0 | 0 |
| 8 | 0 | 0 | 0 | 1 | 0 |
| 9 | 0 | 0 | 0 | 0 | 0 |
| 10 | 0 | 1 | 1 | 0 | 1 |
| 11 | 0 | 0 | 0 | 0 | 0 |
| 12 | 0 | 0 | 1 | 0 | 0 |
| 13 | 0 | 0 | 0 | 0 | 0 |
| 14 | 0 | 0 | 0 | 0 | 0 |
| 15 | 0 | 0 | 0 | 0 | 0 |
| 16 | 0 | 0 | 0 | 1 | 0 |
| 17 | 0 | 0 | 0 | 1 | 0 |
| 18 | 0 | 1 | 0 | 1 | 1 |
| 19 | 0 | 0 | 0 | 0 | 0 |
| 20 | 0 | 0 | 0 | 0 | 0 |
| 21 | 1 | 1 | 1 | 1 | 0 |
| 22 | 0 | 0 | 0 | 0 | 0 |
| 23 | 0 | 0 | 0 | 0 | 0 |

TABLE 14-continued

| Transition number | Sam84 | Sam85 | Sam86 | Sam87 | Sam88 |
|---|---|---|---|---|---|
| 24 | 0 | 0 | 0 | 0 | 0 |
| 25 | 1 | 1 | 1 | 1 | 1 |
| 26 | 1 | 1 | 0 | 1 | 1 |
| 27 | 1 | 1 | 0 | 1 | 1 |
| 28 | 0 | 1 | 0 | 1 | 1 |
| 29 | 0 | 1 | 0 | 1 | 1 |
| 30 | 0 | 1 | 0 | 1 | 1 |
| 31 | 0 | 0 | 0 | 0 | 0 |
| 32 | 0 | 0 | 0 | 0 | 0 |
| 33 | 0 | 0 | 0 | 0 | 0 |
| 34 | 0 | 0 | 0 | 0 | 0 |
| 35 | 0 | 0 | 0 | 0 | 0 |
| 36 | 0 | 0 | 0 | 0 | 0 |
| 37 | 0 | 0 | 0 | 0 | 0 |
| 38 | 0 | 0 | 0 | 0 | 0 |
| 39 | 0 | 0 | 0 | 0 | 0 |
| 40 | 0 | 0 | 0 | 0 | 0 |
| 41 | 0 | 0 | 0 | 0 | 0 |
| 42 | 0 | 0 | 0 | 0 | 0 |
| 43 | 0 | 0 | 0 | 0 | 0 |
| 44 | 0 | 0 | 0 | 0 | 0 |
| 45 | 0 | 0 | 0 | 0 | 0 |
| 46 | 0 | 0 | 0 | 0 | 0 |
| 47 | 0 | 0 | 0 | 0 | 0 |
| 48 | 0 | 0 | 0 | 0 | 0 |
| 49 | 0 | 0 | 0 | 0 | 0 |
| 50 | 0 | 0 | 0 | 0 | 0 |
| 51 | 0 | 0 | 0 | 0 | 0 |
| 52 | 0 | 0 | 0 | 1 | 0 |
| 53 | 0 | 0 | 0 | 1 | 0 |
| 54 | 0 | 0 | 0 | 1 | 0 |
| 55 | 0 | 0 | 0 | 0 | 0 |
| 56 | 0 | 0 | 0 | 0 | 0 |
| 57 | 0 | 0 | 0 | 0 | 0 |
| 58 | 0 | 0 | 0 | 0 | 0 |
| 59 | 0 | 0 | 0 | 0 | 0 |
| 60 | 0 | 0 | 0 | 0 | 0 |
| 61 | 0 | 0 | 0 | 0 | 0 |
| 62 | 0 | 0 | 0 | 0 | 0 |
| 63 | 0 | 0 | 0 | 0 | 0 |
| 64 | 0 | 0 | 0 | 0 | 0 |
| 65 | 0 | 0 | 0 | 0 | 0 |
| 66 | 0 | 0 | 0 | 0 | 0 |
| 67 | 0 | 0 | 0 | 0 | 0 |
| 68 | 0 | 0 | 0 | 0 | 0 |
| 69 | 0 | 0 | 0 | 0 | 0 |
| 70 | 0 | 0 | 0 | 0 | 0 |
| 71 | 0 | 0 | 0 | 0 | 0 |
| 72 | 0 | 0 | 0 | 0 | 0 |
| 73 | 0 | 0 | 0 | 0 | 0 |
| 74 | 1 | 0 | 0 | 0 | 0 |
| 75 | 0 | 0 | 0 | 0 | 0 |
| 76 | 0 | 0 | 0 | 0 | 0 |
| 77 | 0 | 0 | 0 | 0 | 0 |
| 78 | 1 | 0 | 0 | 0 | 0 |
| 79 | 0 | 0 | 0 | 0 | 0 |
| 80 | 0 | 0 | 0 | 0 | 0 |
| 81 | 0 | 0 | 0 | 0 | 0 |
| 82 | 1 | 0 | 0 | 1 | 0 |
| 83 | 0 | 0 | 0 | 0 | 0 |
| 84 | 0 | 0 | 0 | 0 | 0 |
| 85 | 0 | 0 | 0 | 0 | 0 |
| 86 | 0 | 0 | 0 | 0 | 0 |
| 87 | 0 | 0 | 0 | 0 | 0 |
| 88 | 0 | 0 | 0 | 0 | 0 |
| 89 | 0 | 0 | 0 | 0 | 0 |
| 90 | 0 | 0 | 0 | 0 | 0 |
| 91 | 0 | 0 | 0 | 0 | 0 |
| 92 | 0 | 0 | 0 | 0 | 0 |
| 93 | 0 | 0 | 0 | 0 | 0 |
| 94 | 0 | 0 | 0 | 0 | 0 |
| 95 | 0 | 0 | 0 | 0 | 0 |
| 96 | 0 | 0 | 0 | 0 | 0 |
| 97 | 0 | 0 | 0 | 0 | 0 |
| 98 | 0 | 0 | 0 | 0 | 0 |
| 99 | 0 | 0 | 0 | 0 | 0 |
| 100 | 0 | 0 | 0 | 0 | 0 |
| 101 | 0 | 0 | 0 | 0 | 0 |
| 102 | 0 | 0 | 0 | 0 | 0 |
| 103 | 0 | 0 | 0 | 0 | 0 |
| 104 | 0 | 0 | 0 | 0 | 0 |
| 105 | 0 | 0 | 0 | 0 | 0 |
| 106 | 0 | 0 | 0 | 0 | 0 |
| 107 | 0 | 0 | 0 | 0 | 0 |
| 108 | 0 | 0 | 0 | 0 | 0 |
| 109 | 0 | 0 | 0 | 0 | 0 |
| 110 | 0 | 0 | 0 | 0 | 0 |
| 111 | 0 | 0 | 0 | 0 | 0 |
| 112 | 0 | 0 | 0 | 0 | 0 |
| 113 | 0 | 0 | 0 | 0 | 0 |
| 114 | 0 | 0 | 0 | 0 | 0 |
| 115 | 0 | 0 | 0 | 0 | 0 |
| 116 | 0 | 0 | 0 | 0 | 0 |
| 117 | 0 | 0 | 0 | 0 | 0 |
| 118 | 0 | 0 | 0 | 0 | 0 |
| 119 | 0 | 0 | 0 | 0 | 0 |
| 120 | 0 | 0 | 0 | 0 | 0 |
| 121 | 0 | 0 | 0 | 0 | 0 |
| 122 | 0 | 0 | 0 | 0 | 0 |
| 123 | 0 | 0 | 0 | 0 | 0 |
| 124 | 0 | 0 | 0 | 0 | 0 |
| 125 | 0 | 0 | 0 | 0 | 0 |
| 126 | 0 | 0 | 0 | 0 | 0 |
| 127 | 0 | 0 | 0 | 0 | 0 |
| 128 | 0 | 0 | 0 | 0 | 0 |
| 129 | 0 | 0 | 0 | 0 | 0 |
| 130 | 0 | 0 | 0 | 0 | 0 |
| 131 | 0 | 0 | 0 | 0 | 0 |
| 132 | 0 | 0 | 0 | 0 | 0 |
| 133 | 0 | 1 | 0 | 0 | 1 |
| 134 | 0 | 1 | 0 | 0 | 1 |
| 135 | 0 | 1 | 0 | 0 | 1 |
| 136 | 1 | 0 | 0 | 0 | 0 |
| 137 | 1 | 0 | 0 | 1 | 0 |
| 138 | 1 | 0 | 0 | 0 | 1 |
| 139 | 0 | 0 | 0 | 0 | 0 |
| 140 | 0 | 0 | 0 | 0 | 0 |
| 141 | 0 | 0 | 0 | 0 | 0 |
| 142 | 0 | 0 | 0 | 0 | 0 |
| 143 | 0 | 0 | 0 | 0 | 0 |
| 144 | 0 | 0 | 0 | 0 | 0 |
| 145 | 1 | 0 | 0 | 0 | 0 |
| 146 | 1 | 0 | 0 | 1 | 0 |
| 147 | 1 | 0 | 0 | 0 | 0 |
| 148 | 0 | 0 | 0 | 0 | 0 |
| 149 | 0 | 0 | 0 | 0 | 0 |
| 150 | 0 | 0 | 0 | 0 | 0 |
| 151 | 0 | 0 | 0 | 0 | 0 |
| 152 | 0 | 0 | 0 | 0 | 0 |
| 153 | 0 | 0 | 0 | 0 | 0 |
| 154 | 0 | 0 | 0 | 0 | 0 |
| 155 | 0 | 0 | 0 | 0 | 0 |
| 156 | 0 | 0 | 0 | 0 | 0 |
| 157 | 0 | 0 | 0 | 0 | 0 |
| 158 | 0 | 0 | 0 | 0 | 0 |
| 159 | 0 | 0 | 0 | 0 | 0 |
| 160 | 0 | 0 | 0 | 0 | 0 |
| 161 | 0 | 0 | 0 | 0 | 0 |
| 162 | 0 | 0 | 0 | 0 | 0 |
| 163 | 0 | 0 | 0 | 0 | 0 |
| 164 | 0 | 0 | 0 | 0 | 0 |
| 165 | 0 | 0 | 0 | 0 | 0 |
| 166 | 0 | 0 | 0 | 0 | 0 |
| 167 | 0 | 0 | 0 | 0 | 0 |
| 168 | 0 | 0 | 0 | 0 | 0 |
| 169 | 0 | 0 | 0 | 0 | 0 |
| 170 | 0 | 0 | 0 | 0 | 0 |
| 171 | 0 | 0 | 0 | 0 | 0 |
| 172 | 0 | 0 | 0 | 0 | 0 |
| 173 | 0 | 0 | 0 | 0 | 0 |
| 174 | 0 | 0 | 0 | 0 | 0 |
| 175 | 0 | 1 | 0 | 1 | 1 |
| 176 | 0 | 1 | 0 | 1 | 1 |
| 177 | 1 | 1 | 0 | 1 | 1 |
| 178 | 0 | 0 | 0 | 0 | 0 |
| 179 | 0 | 0 | 0 | 0 | 0 |

TABLE 14-continued

| Transition number | Sam84 | Sam85 | Sam86 | Sam87 | Sam88 |
|---|---|---|---|---|---|
| 180 | 0 | 0 | 0 | 0 | 0 |
| 181 | 0 | 0 | 0 | 0 | 0 |
| 182 | 0 | 0 | 0 | 0 | 0 |
| 183 | 0 | 0 | 0 | 0 | 0 |
| 184 | 0 | 0 | 0 | 0 | 0 |
| 185 | 0 | 0 | 0 | 0 | 0 |
| 186 | 0 | 0 | 0 | 0 | 0 |
| 187 | 0 | 0 | 0 | 1 | 0 |
| 188 | 0 | 0 | 0 | 1 | 0 |
| 189 | 0 | 1 | 0 | 1 | 0 |
| 190 | 0 | 0 | 0 | 0 | 0 |
| 191 | 0 | 0 | 0 | 0 | 0 |
| 192 | 0 | 0 | 0 | 0 | 0 |
| 193 | 0 | 0 | 0 | 0 | 0 |
| 194 | 0 | 0 | 0 | 0 | 0 |
| 195 | 0 | 0 | 0 | 0 | 0 |

Samples Sam84 to Sam88 comprise at least one peptide which is characteristic of INDs. The bacteria present in samples Sam84 to Sam88 therefore express a beta-lactamase which confers on them a resistance to penicillins, to cephalosporins and to carbapenems.

EXAMPLE 10

Identification of a Resistance to GES Beta-Lactams

Samples Sam89 and Sam90 are identified according to one of the methods described in examples 1, 3 or 4. The identification of the species is set out in TABLE 15.

TABLE 15

| Names | Species |
|---|---|
| Sam89 | E. coli |
| Sam90 | P. aeruginosa |

Samples Sam89 and Sam90 correspond to a species able to comprise a GES resistance mechanism. The following method is then performed to detect such a mechanism.

Each sample is treated according to Example 5, then analysed according to Example 6 unless otherwise stated in the rest of the example, by detecting the peptides from TABLE 16 instead of the peptides from TABLE 3.

TABLE 16

| Transition number | Peptide | Retention time (minutes) | (m/z) filtered in Q1 | (m/z) filtered in Q3 | Declustering potential (eV) | Collision energy (eV) |
|---|---|---|---|---|---|---|
| 1 | AAEIGVAIVDPQGEIVAGHR | 19.11 | 668.03 | 695.88 | 79.8 | 37.4 |
| 2 | AAEIGVAIVDPQGEIVAGHR | 19.13 | 668.03 | 731.39 | 79.8 | 37.4 |
| 3 | AAEIGVAIVDPQGEIVAGHR | 19.11 | 668.03 | 809.44 | 79.8 | 37.4 |
| 4 | AAQIGVAIVDPQGEIVAGHR | 18.76 | 667.70 | 695.88 | 79.8 | 37.4 |
| 5 | AAQIGVAIVDPQGEIVAGHR | 18.76 | 667.70 | 731.39 | 79.8 | 37.4 |
| 6 | AAQIGVAIVDPQGEIVAGHR | 18.76 | 667.70 | 809.44 | 79.8 | 37.4 |
| 7 | DTTTPIAMAR | 14.23 | 538.77 | 658.37 | 70.4 | 28.7 |
| 8 | DTTTPIAMAR | 14.23 | 538.77 | 759.42 | 70.4 | 28.7 |
| 9 | DTTTPIAMAR | 14.23 | 538.77 | 860.47 | 70.4 | 28.7 |
| 10 | DWVVGEK | 14.41 | 416.71 | 432.25 | 61.5 | 23.3 |
| 11 | DWVVGEK | 14.43 | 416.71 | 531.31 | 61.5 | 23.3 |
| 12 | DWVVGEK | 14.45 | 416.71 | 717.39 | 61.5 | 23.3 |
| 13 | DYAVAVYTTAPK | 15.83 | 649.84 | 680.36 | 78.5 | 33.6 |
| 14 | DYAVAVYTTAPK | 15.83 | 649.84 | 779.43 | 78.5 | 33.6 |
| 15 | DYAVAVYTTAPK | 15.85 | 649.84 | 850.47 | 78.5 | 33.6 |
| 16 | EIGGPAAMTQYFR | 20.03 | 720.85 | 1198.57 | 83.7 | 36.7 |
| 17 | EIGGPAAMTQYFR | 20.03 | 720.85 | 845.40 | 83.7 | 36.7 |
| 18 | EIGGPAAMTQYFR | 20.03 | 720.85 | 916.44 | 83.7 | 36.7 |
| 19 | EPEMGDNTPGDLR | 13.53 | 715.81 | 557.30 | 83.3 | 36.5 |
| 20 | EPEMGDNTPGDLR | 13.53 | 715.81 | 772.40 | 83.3 | 36.5 |
| 21 | EPEMGDNTPGDLR | 13.53 | 715.81 | 944.44 | 83.3 | 36.5 |
| 22 | ESEMSDNTPGDLR | 12.72 | 725.81 | 557.30 | 84 | 36.9 |
| 23 | ESEMSDNTPGDLR | 12.7 | 725.81 | 887.42 | 84 | 36.9 |
| 24 | ESEMSDNTPGDLR | 12.71 | 725.81 | 974.45 | 84 | 36.9 |

TABLE 16-continued

| Transition number | Peptide | Retention time (minutes) | (m/z) filtered in Q1 | (m/z) filtered in Q3 | Declustering potential (eV) | Collision energy (eV) |
|---|---|---|---|---|---|---|
| 25 | FAMCSTFK | 16.14 | 496.22 | 642.29 | 67.3 | 26.8 |
| 26 | FAMCSTFK | 16.12 | 496.22 | 773.33 | 67.3 | 26.8 |
| 27 | FAMCSTFK | 16.12 | 496.22 | 844.37 | 67.3 | 26.8 |
| 28 | FIHALLLAGIAHSAYASEK | 20.93 | 671.37 | 1204.60 | 80.1 | 37.6 |
| 29 | FIHALLLAGIAHSAYASEK | 20.92 | 671.37 | 807.95 | 80.1 | 37.6 |
| 30 | FIHALLLAGIAHSAYASEK | 20.93 | 671.37 | 876.48 | 80.1 | 37.6 |
| 31 | FIHALLLAGTAHSAYASEK | 18.21 | 667.36 | 766.41 | 79.8 | 37.4 |
| 32 | FIHALLLAGTAHSAYASEK | 18.21 | 667.36 | 801.93 | 79.8 | 37.4 |
| 33 | FIHALLLAGTAHSAYASEK | 18.21 | 667.36 | 870.46 | 79.8 | 37.4 |
| 34 | FPLAALVFER | 24.46 | 581.84 | 734.42 | 73.5 | 30.6 |
| 35 | FPLAALVFER | 24.46 | 581.84 | 805.46 | 73.5 | 30.6 |
| 36 | FPLAALVFER | 24.44 | 581.84 | 918.54 | 73.5 | 30.6 |
| 37 | IDSGTER | 1.66 | 389.19 | 462.23 | 59.5 | 22.1 |
| 38 | IDSGTER | 1.84 | 389.19 | 549.26 | 59.5 | 22.1 |
| 39 | IDSGTER | 1.75 | 389.19 | 664.29 | 59.5 | 22.1 |
| 40 | IGDSVSR | 8.48 | 367.20 | 448.25 | 57.9 | 21.2 |
| 41 | IGDSVSR | 8.46 | 367.20 | 563.28 | 57.9 | 21.2 |
| 42 | IGDSVSR | 8.44 | 367.20 | 620.30 | 57.9 | 21.2 |
| 43 | LSAVER | 9.1 | 337.70 | 403.23 | 55.7 | 19.9 |
| 44 | LSAVER | 9.08 | 337.70 | 474.27 | 55.7 | 19.9 |
| 45 | LSAVER | 9.1 | 337.70 | 561.30 | 55.7 | 19.9 |
| 46 | LSYGPDMIVEWSPATER | 22.31 | 650.98 | 573.30 | 78.6 | 36.5 |
| 47 | LSYGPDMIVEWSPATER | 22.29 | 650.98 | 660.33 | 78.6 | 36.5 |
| 48 | LSYGPDMIVEWSPATER | 22.26 | 650.98 | 846.41 | 78.6 | 36.5 |
| 49 | LSYGPDMIVK | 17.71 | 561.80 | 1009.50 | 72.1 | 29.7 |
| 50 | LSYGPDMIVK | 17.69 | 561.80 | 759.41 | 72.1 | 29.7 |
| 51 | LSYGPDMIVK | 17.69 | 561.80 | 922.47 | 72.1 | 29.7 |
| 52 | NDIGFFK | 17.71 | 420.72 | 498.27 | 61.8 | 23.5 |
| 53 | NDIGFFK | 17.69 | 420.72 | 611.36 | 61.8 | 23.5 |
| 54 | NDIGFFK | 17.74 | 420.72 | 726.38 | 61.8 | 23.5 |
| 55 | TDLEK | 3.66 | 303.16 | 389.24 | 53.2 | 18.3 |
| 56 | TDLEK | 3.73 | 303.16 | 459.21 | 53.2 | 18.3 |
| 57 | TDLEK | 3.6 | 303.16 | 504.27 | 53.2 | 18.3 |
| 58 | TGACANGAR | 1.48 | 439.20 | 648.29 | 63.1 | 24.3 |
| 59 | TGACANGAR | 1.48 | 439.20 | 719.33 | 63.1 | 24.3 |
| 60 | TGACANGAR | 1.48 | 439.20 | 776.35 | 63.1 | 24.3 |
| 61 | TGTCANGAR | 1.48 | 454.21 | 648.29 | 64.2 | 25 |
| 62 | TGTCANGAR | 1.48 | 454.21 | 749.34 | 64.2 | 25 |

TABLE 16-continued

| Transition number | Peptide | Retention time (minutes) | (m/z) filtered in Q1 | (m/z) filtered in Q3 | Declustering potential (eV) | Collision energy (eV) |
|---|---|---|---|---|---|---|
| 63 | TGTCANGAR | 1.48 | 454.21 | 806.36 | 64.2 | 25 |
| 64 | TGTCANGGR | 1.48 | 447.20 | 474.24 | 63.7 | 24.7 |
| 65 | TGTCANGGR | 1.48 | 447.20 | 634.27 | 63.7 | 24.7 |
| 66 | TGTCANGGR | 1.48 | 447.20 | 735.32 | 63.7 | 24.7 |
| 67 | VLYGGALTSTSTHTIER | 15.87 | 602.65 | 1245.64 | 75.1 | 34.1 |
| 68 | VLYGGALTSTSTHTIER | 15.85 | 602.65 | 715.87 | 75.1 | 34.1 |
| 69 | VLYGGALTSTSTHTIER | 15.87 | 602.65 | 797.40 | 75.1 | 34.1 |
| 70 | WLIGNQTGDATLR | 18.93 | 722.88 | 1032.51 | 83.8 | 36.8 |
| 71 | WLIGNQTGDATLR | 19.02 | 722.88 | 1145.59 | 83.8 | 36.8 |
| 72 | WLIGNQTGDATLR | 18.96 | 722.88 | 733.38 | 83.8 | 36.8 |
| 73 | WSPATER | 11.37 | 423.71 | 476.25 | 62 | 23.6 |
| 74 | WSPATER | 11.37 | 423.71 | 573.30 | 62 | 23.6 |
| 75 | WSPATER | 11.34 | 423.71 | 660.33 | 62 | 23.6 |

The other machine parameters used are as follows:

| | |
|---|---|
| Scan type: | MRM |
| MRM planned: | yes |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 40.00 psi |
| Cone voltage: | 5500.00 V |
| Source temperature: | 500.00° C. |
| Nebulising gas: | 50.00 psi |
| Heating gas: | 50.00 psi |
| Collision gas which induces dissociation: | 9.00 psi |
| Dynamic filling: | activated |
| Entry potential before Q0 (EP): | 10.00 V |
| Collision cell exit potential (CXP): | 15.00 V |

The areas obtained for each of the transitions and for each of the microorganisms studied were measured. When the areas of the transitions are greater than or equal to the positivity threshold described in TABLE 16, the detection of the transition is considered to be positive and is labelled "1" in TABLE 17. When a transition has an area less than the positivity threshold described in TABLE 16, the transition is considered non-detected and is labelled "0" in TABLE 17.

For a given peptide, when at least 3 transitions are labelled "1", the peptide is considered as being detected.

TABLE 17

| Transition number | Sam89 | Sam90 |
|---|---|---|
| 1 | 0 | 0 |
| 2 | 0 | 0 |
| 3 | 0 | 0 |
| 4 | 0 | 0 |
| 5 | 1 | 1 |
| 6 | 0 | 0 |
| 7 | 1 | 1 |
| 8 | 1 | 1 |
| 9 | 1 | 1 |
| 10 | 1 | 1 |
| 11 | 1 | 1 |
| 12 | 1 | 1 |
| 13 | 0 | 0 |
| 14 | 0 | 0 |
| 15 | 0 | 0 |
| 16 | 0 | 0 |
| 17 | 0 | 0 |
| 18 | 0 | 0 |
| 19 | 0 | 0 |
| 20 | 0 | 0 |
| 21 | 0 | 0 |
| 22 | 0 | 0 |
| 23 | 0 | 0 |
| 24 | 0 | 0 |
| 25 | 0 | 0 |
| 26 | 0 | 0 |
| 27 | 0 | 0 |
| 28 | 0 | 0 |
| 29 | 0 | 0 |
| 30 | 0 | 0 |
| 31 | 0 | 0 |
| 32 | 0 | 0 |
| 33 | 0 | 0 |
| 34 | 0 | 0 |
| 35 | 0 | 0 |
| 36 | 0 | 0 |
| 37 | 1 | 1 |
| 38 | 1 | 1 |
| 39 | 1 | 1 |
| 40 | 1 | 1 |
| 41 | 1 | 1 |
| 42 | 1 | 1 |
| 43 | 1 | 1 |
| 44 | 1 | 1 |
| 45 | 1 | 1 |
| 46 | 1 | 1 |

TABLE 17-continued

| Transition number | Sam89 | Sam90 |
|---|---|---|
| 47 | 1 | 1 |
| 48 | 1 | 1 |
| 49 | 0 | 0 |
| 50 | 0 | 0 |
| 51 | 0 | 0 |
| 52 | 1 | 1 |
| 53 | 1 | 1 |
| 54 | 1 | 1 |
| 55 | 0 | 0 |
| 56 | 0 | 0 |
| 57 | 0 | 0 |
| 58 | 0 | 0 |
| 59 | 0 | 0 |
| 60 | 0 | 0 |
| 61 | 0 | 0 |
| 62 | 0 | 0 |
| 63 | 0 | 0 |
| 64 | 1 | 0 |
| 65 | 0 | 1 |
| 66 | 1 | 1 |
| 67 | 1 | 1 |
| 68 | 1 | 1 |
| 69 | 1 | 1 |
| 70 | 1 | 1 |
| 71 | 1 | 1 |
| 72 | 1 | 1 |
| 73 | 0 | 0 |
| 74 | 0 | 0 |
| 75 | 0 | 0 |

Samples Sam89 and Sam90 comprise at least one peptide which is characteristic of the carbapenemase phenotype. The bacteria present in samples Sam89 to Sam90 therefore express a beta-lactamase which confers on them a resistance to penicillins, to cephalosporins and to carbapenems.

EXAMPLE 11

Identification of a Resistance to SME Beta-Lactams

Samples Sam91 to Sam95 are identified according to one of the methods described in examples 1, 3 or 4. The identification of the species is set out in TABLE 18.

TABLE 18

| Names | Species |
|---|---|
| Sam91 | *S. marcescens* |
| Sam92 | *S. marcescens* |
| Sam93 | *S. marcescens* |
| Sam94 | *S. marcescens* |
| Sam95 | *S. marcescens* |

Samples Sam91 to Sam95 correspond to a species able to comprise an SME resistance mechanism. The following method is then performed to detect such a mechanism.

Each sample is treated according to Example 5, then analysed according to Example 6 unless otherwise stated in the rest of the example, by detecting the peptides from TABLE 19 instead of the peptides from TABLE 3.

TABLE 19

| Transition number | Peptide | Retention time (minutes) | (m/z) filtered in Q1 | (m/z) filtered in Q3 | Collision energy (eV) | positivity threshold |
|---|---|---|---|---|---|---|
| 1 | AIYQNWLK | 18.69 | 518.29 | 426.22 | 25.3 | 2500 |
| 2 | AIYQNWLK | 18.69 | 518.29 | 688.38 | 25.3 | 2500 |
| 3 | AIYQNWLK | 18.69 | 518.29 | 851.44 | 25.3 | 2500 |
| 4 | APLIVSIYTTR | 20.21 | 617.36 | 740.39 | 30.9 | 2500 |
| 5 | APLIVSIYTTR | 20.21 | 617.36 | 839.46 | 30.9 | 2500 |
| 6 | APLIVSIYTTR | 20.21 | 617.36 | 952.55 | 30.9 | 2500 |
| 7 | ASVPADWVVGDK | 17.56 | 622.32 | 493.75 | 31.2 | 2500 |
| 8 | ASVPADWVVGDK | 17.56 | 622.32 | 543.29 | 31.2 | 2500 |
| 9 | ASVPADWVVGDK | 17.56 | 622.32 | 986.49 | 31.2 | 2500 |
| 10 | AVANSLNK | 8.75 | 408.73 | 461.27 | 19 | 2500 |
| 11 | AVANSLNK | 8.75 | 408.73 | 575.32 | 19 | 2500 |
| 12 | AVANSLNK | 8.75 | 408.73 | 646.35 | 19 | 2500 |
| 13 | DLEYHSPITTK | 14.48 | 435.22 | 473.75 | 20.6 | 2500 |
| 14 | DLEYHSPITTK | 14.48 | 435.22 | 538.28 | 20.6 | 2500 |
| 15 | DLEYHSPITTK | 14.48 | 435.22 | 646.38 | 20.6 | 2500 |
| 16 | DLEYYSPITTK | 17.4 | 665.33 | 559.35 | 33.7 | 2500 |
| 17 | DLEYYSPITTK | 17.4 | 665.33 | 646.38 | 33.7 | 2500 |
| 18 | DLEYYSPITTK | 17.4 | 665.33 | 809.44 | 33.7 | 2500 |
| 19 | DTSTPK | 1.45 | 324.66 | 345.21 | 14.2 | 2500 |

TABLE 19-continued

| Transition number | Peptide | Retention time (minutes) | (m/z) filtered in Q1 | (m/z) filtered in Q3 | Collision energy (eV) | positivity threshold |
|---|---|---|---|---|---|---|
| 20 | DTSTPK | 1.45 | 324.66 | 432.25 | 14.2 | 2500 |
| 21 | DTSTPK | 1.45 | 324.66 | 533.29 | 14.2 | 2500 |
| 22 | FLGGPEGMTK | 14.94 | 518.76 | 662.32 | 25.3 | 2500 |
| 23 | FLGGPEGMTK | 14.94 | 518.76 | 719.34 | 25.3 | 2500 |
| 24 | FLGGPEGMTK | 14.94 | 518.76 | 776.36 | 25.3 | 2500 |
| 25 | GFLAAAVLER | 20.49 | 523.80 | 587.35 | 25.6 | 2500 |
| 26 | GFLAAAVLER | 20.49 | 523.80 | 658.39 | 25.6 | 2500 |
| 27 | GFLAAAVLER | 20.49 | 523.80 | 729.43 | 25.6 | 2500 |
| 28 | GNTTGDAR | 6.45 | 396.19 | 418.20 | 18.3 | 2500 |
| 29 | GNTTGDAR | 6.45 | 396.19 | 519.25 | 18.3 | 2500 |
| 30 | GNTTGDAR | 6.45 | 396.19 | 620.30 | 18.3 | 2500 |
| 31 | IGVFAIDTGSGNTFGYR | 21.45 | 592.30 | 542.27 | 25.4 | 2500 |
| 32 | IGVFAIDTGSGNTFGYR | 21.45 | 887.94 | 1174.51 | 46.3 | 2500 |
| 33 | IGVFAIDTGSGNTFGYR | 21.45 | 887.94 | 958.44 | 46.3 | 2500 |
| 34 | LALGNVLNAK | 18.56 | 506.81 | 414.75 | 24.6 | 2500 |
| 35 | LALGNVLNAK | 18.56 | 506.81 | 715.41 | 24.6 | 2500 |
| 36 | LALGNVLNAK | 18.56 | 506.81 | 828.49 | 24.6 | 2500 |
| 37 | LDINQK | 10.3 | 365.71 | 389.21 | 16.6 | 2500 |
| 38 | LDINQK | 10.3 | 365.71 | 502.30 | 16.6 | 2500 |
| 39 | LDINQK | 10.3 | 365.71 | 617.33 | 16.6 | 2500 |
| 40 | LEEDFDGR | 12.51 | 490.72 | 609.26 | 23.7 | 2500 |
| 41 | LEEDFDGR | 12.51 | 490.72 | 738.31 | 23.7 | 2500 |
| 42 | LEEDFDGR | 12.51 | 490.72 | 867.35 | 23.7 | 2500 |
| 43 | SDAAAK | 7.06 | 281.65 | 289.19 | 11.8 | 2500 |
| 44 | SDAAAK | 7.06 | 281.65 | 360.22 | 11.8 | 2500 |
| 45 | SDAAAK | 7.06 | 281.65 | 475.25 | 11.8 | 2500 |
| 46 | SIGDNEFR | 12.81 | 469.22 | 565.27 | 22.5 | 2500 |
| 47 | SIGDNEFR | 12.81 | 469.22 | 680.30 | 22.5 | 2500 |
| 48 | SIGDNEFR | 12.81 | 469.22 | 737.32 | 22.5 | 2500 |
| 49 | TGSCGAIGTANDYAVIWPK | 20.29 | 660.99 | 430.25 | 27.6 | 2500 |
| 50 | TGSCGAIGTANDYAVIWPK | 20.29 | 660.99 | 713.43 | 27.6 | 2500 |
| 51 | TGSCGAIGTANDYAVIWPK | 20.29 | 990.98 | 430.25 | 52.2 | 2500 |
| 52 | TGSCGAYGTANDYAVIWPK | 19.78 | 1015.97 | 430.25 | 53.6 | 2500 |
| 53 | TGSCGAYGTANDYAVIWPK | 19.78 | 677.65 | 642.40 | 28.1 | 2500 |
| 54 | TGSCGAYGTANDYAVIWPK | 19.78 | 677.65 | 713.43 | 28.1 | 2500 |
| 55 | TIAEASR | 6.98 | 374.20 | 333.19 | 17.1 | 2500 |
| 56 | TIAEASR | 6.98 | 374.20 | 462.23 | 17.1 | 2500 |
| 57 | TIAEASR | 6.98 | 374.20 | 646.35 | 17.1 | 2500 |

TABLE 19-continued

| Transition number | Peptide | Retention time (minutes) | (m/z) filtered in Q1 | (m/z) filtered in Q3 | Collision energy (eV) | positivity threshold |
|---|---|---|---|---|---|---|
| 58 | WELELNTAIPGDK | 21.06 | 495.92 | 416.21 | 22.5 | 2500 |
| 59 | WELELNTAIPGDK | 21.06 | 743.38 | 1170.64 | 38.1 | 2500 |
| 60 | WELELNTAIPGDK | 21.06 | 743.38 | 416.21 | 38.1 | 2500 |

The other machine parameters used are as follows:

| | |
|---|---|
| Scan type: | MRM |
| MRM planned: | yes |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 40.00 psi |
| Cone voltage: | 5500.00 V |
| Source temperature: | 500.00° C. |
| Nebulising gas: | 50.00 psi |
| Heating gas: | 50.00 psi |
| Collision gas which induces dissociation: | 9.00 psi |
| Dynamic filling: | activated |
| Declustering potential (DP): | 100.00 V |
| Entry potential before Q0 (EP): | 10.00 V |
| Collision cell exit potential (CXP): | 15.00 V |

The areas obtained for each of the transitions and for each of the microorganisms studied were measured. When the areas of the transitions are greater than or equal to the positivity threshold described in TABLE 19, the detection of the transition is considered to be positive and is labelled "1" in TABLE 20. When a transition has an area less than the positivity threshold described in TABLE 19, the transition is considered non-detected and is labelled "0" in TABLE 20.

For a given peptide, when at least 3 transitions are labelled "1", the peptide is considered as being detected.

TABLE 20

| Transition number | Sam91 | Sam92 | Sam93 | Sam94 | Sam95 |
|---|---|---|---|---|---|
| 1 | 0 | 1 | 0 | 0 | 0 |
| 2 | 1 | 1 | 0 | 0 | 1 |
| 3 | 0 | 1 | 0 | 0 | 0 |
| 4 | 0 | 0 | 0 | 0 | 0 |
| 5 | 0 | 0 | 0 | 0 | 0 |
| 6 | 0 | 0 | 0 | 0 | 0 |
| 7 | 1 | 1 | 1 | 1 | 1 |
| 8 | 1 | 1 | 1 | 1 | 1 |
| 9 | 1 | 1 | 1 | 1 | 1 |
| 10 | 1 | 1 | 1 | 1 | 1 |
| 11 | 1 | 1 | 1 | 1 | 1 |
| 12 | 1 | 1 | 1 | 1 | 1 |
| 13 | 1 | 1 | 1 | 1 | 1 |
| 14 | 1 | 1 | 1 | 1 | 1 |
| 15 | 1 | 1 | 1 | 1 | 1 |
| 16 | 0 | 0 | 0 | 0 | 0 |
| 17 | 0 | 0 | 0 | 0 | 0 |
| 18 | 0 | 0 | 0 | 0 | 0 |
| 19 | 0 | 0 | 0 | 0 | 0 |
| 20 | 0 | 0 | 0 | 0 | 0 |
| 21 | 0 | 0 | 0 | 0 | 0 |
| 22 | 1 | 1 | 1 | 0 | 1 |
| 23 | 1 | 1 | 1 | 0 | 1 |
| 24 | 1 | 1 | 1 | 0 | 1 |
| 25 | 1 | 1 | 1 | 1 | 1 |
| 26 | 1 | 1 | 1 | 1 | 1 |
| 27 | 1 | 1 | 1 | 1 | 1 |
| 28 | 0 | 0 | 0 | 0 | 0 |
| 29 | 0 | 0 | 0 | 0 | 0 |
| 30 | 0 | 0 | 0 | 0 | 0 |
| 31 | 0 | 0 | 0 | 0 | 0 |
| 32 | 0 | 0 | 0 | 0 | 0 |
| 33 | 0 | 0 | 0 | 0 | 0 |
| 34 | 1 | 1 | 1 | 1 | 1 |
| 35 | 1 | 1 | 1 | 1 | 1 |
| 36 | 1 | 1 | 1 | 1 | 1 |
| 37 | 0 | 0 | 0 | 0 | 0 |
| 38 | 0 | 0 | 0 | 0 | 0 |
| 39 | 0 | 0 | 0 | 0 | 0 |
| 40 | 1 | 1 | 1 | 0 | 1 |
| 41 | 1 | 1 | 1 | 0 | 1 |
| 42 | 1 | 1 | 1 | 0 | 1 |
| 43 | 0 | 0 | 0 | 0 | 0 |
| 44 | 0 | 0 | 0 | 0 | 0 |
| 45 | 0 | 0 | 0 | 0 | 0 |
| 46 | 0 | 0 | 1 | 0 | 0 |
| 47 | 0 | 0 | 1 | 0 | 0 |
| 48 | 0 | 0 | 1 | 0 | 0 |
| 49 | 0 | 0 | 0 | 0 | 0 |
| 50 | 0 | 0 | 0 | 0 | 0 |
| 51 | 0 | 0 | 0 | 0 | 0 |
| 52 | 0 | 0 | 0 | 0 | 0 |
| 53 | 0 | 0 | 0 | 0 | 0 |
| 54 | 0 | 0 | 0 | 0 | 0 |
| 55 | 0 | 0 | 0 | 0 | 0 |
| 56 | 0 | 0 | 0 | 0 | 0 |
| 57 | 0 | 0 | 0 | 0 | 0 |
| 58 | 0 | 0 | 0 | 0 | 0 |
| 59 | 0 | 0 | 0 | 0 | 0 |
| 60 | 0 | 0 | 0 | 0 | 0 |

Samples Sam91 to Sam95 comprise at least one peptide which is characteristic of SMEs. The bacteria present in samples Sam91 to Sam95 therefore express a beta-lactamase which confers on them a resistance to penicillins, to cephalosporins and to carbapenems.

EXAMPLE 12

Identification of a Resistance to IMP Beta-Lactams

The samples corresponding to a species able to comprise an IMP resistance mechanism can be detected by employing the following method.

Each sample is treated according to Example 5, then analysed according to Example 6 by detecting the peptides from TABLE 21 instead of the peptides from TABLE 3.

TABLE 21

| Transition number | Peptide | Retention time (minutes) | (m/z) filtered in Q1 | (m/z) filtered in Q3 | Collision energy (eV) |
|---|---|---|---|---|---|
| 1 | EVNGWGWPK | 16.02 | 542.79 | 742.35 | 29 |
| 2 | EVNGWGWPK | 16.02 | 542.79 | 856.47 | 29 |
| 3 | EVNGWGWPK | 16.02 | 542.79 | 955.54 | 29 |
| 4 | GSISSHFHSDSTGGIGWLNSR | 16.97 | 551.26 | 675.36 | 31 |
| 5 | GSISSHFHSDSTGGIGWLNSR | 16.97 | 551.26 | 732.38 | 31 |
| 6 | GSISSHFHSDSTGGIGWLNSR | 16.97 | 734.68 | 959.51 | 41 |
| 7 | HGLVILVNTDAYLIDTPFTAK | 24.53 | 767.75 | 892.48 | 42 |
| 8 | HGLVILVNTDAYLIDTPFTAK | 24.53 | 767.75 | 1005.56 | 42 |
| 9 | HGLVILVNTDAYLIDTPFTAK | 24.53 | 767.75 | 1133.63 | 42 |
| 10 | HGLVVLVNNDAYLIDTPFTNK | 22.75 | 781.75 | 822.4 | 43 |
| 11 | HGLVVLVNNDAYLIDTPFTNK | 22.75 | 781.75 | 935.48 | 43 |
| 12 | HGLVVLVNNDAYLIDTPFTNK | 22.75 | 781.75 | 1132.61 | 43 |
| 13 | HGLVVLVNTDAYLIDTPFTAK | 23.91 | 763.08 | 779.39 | 42 |
| 14 | HGLVVLVNTDAYLIDTPFTAK | 23.91 | 763.08 | 892.48 | 42 |
| 15 | HGLVVLVNTDAYLIDTPFTAK | 23.91 | 763.08 | 1119.62 | 42 |
| 16 | HGLVVLVNTEAYLIDTPFTAK | 24.53 | 767.75 | 779.39 | 42 |
| 17 | HGLVVLVNTEAYLIDTPFTAK | 24.53 | 767.75 | 892.48 | 42 |
| 18 | HGLVVLVNTEAYLIDTPFTAK | 24.53 | 767.75 | 1133.63 | 42 |
| 19 | IEVFYPGPGHTQDNVVVWLPK | 22.25 | 599.57 | 642.4 | 33 |
| 20 | IEVFYPGPGHTQDNVVVWLPK | 22.25 | 599.57 | 741.47 | 33 |
| 21 | IEVFYPGPGHTQDNVVVWLPK | 22.25 | 799.09 | 872.46 | 44 |
| 22 | ILMEK | 11.28 | 317.19 | 407.2 | 19 |
| 23 | ILMEK | 11.28 | 317.19 | 487.26 | 19 |
| 24 | ILMEK | 11.28 | 317.19 | 520.28 | 19 |
| 25 | ILMSK | 10.48 | 296.18 | 365.19 | 18 |
| 26 | ILMSK | 10.48 | 296.18 | 445.25 | 18 |
| 27 | ILMSK | 10.48 | 296.18 | 478.27 | 18 |
| 28 | LDEGVYVHTSFK | 15.03 | 465.57 | 482.26 | 27 |
| 29 | LDEGVYVHTSFK | 15.03 | 465.57 | 619.32 | 27 |
| 30 | LDEGVYVHTSFK | 15.03 | 465.57 | 881.45 | 27 |
| 31 | LEEGVYVHTSYEEVK | 14.55 | 594.62 | 855.41 | 34 |
| 32 | LEEGVYVHTSYEEVK | 14.55 | 594.62 | 992.47 | 34 |
| 33 | LEEGVYVHTSYEEVK | 14.55 | 891.43 | 992.47 | 44 |
| 34 | LLISK | 12.19 | 287.2 | 347.23 | 18 |
| 35 | LLISK | 12.19 | 287.2 | 427.29 | 18 |
| 36 | LLISK | 12.19 | 287.2 | 460.31 | 18 |
| 37 | LLMSK | 11.18 | 296.18 | 365.19 | 18 |
| 38 | LLMSK | 11.18 | 296.18 | 445.25 | 18 |

TABLE 21-continued

| Transition number | Peptide | Retention time (minutes) | (m/z) filtered in Q1 | (m/z) filtered in Q3 | Collision energy (eV) |
|---|---|---|---|---|---|
| 39 | LLMSK | 11.18 | 296.18 | 478.27 | 18 |
| 40 | LLVSK | 10.48 | 280.19 | 333.21 | 17 |
| 41 | LLVSK | 10.48 | 280.19 | 413.28 | 17 |
| 42 | LLVSK | 10.48 | 280.19 | 446.3 | 17 |
| 43 | LPDLK | 12.56 | 293.18 | 375.22 | 18 |
| 44 | LPDLK | 12.56 | 293.18 | 439.26 | 18 |
| 45 | LPDLK | 12.56 | 293.18 | 472.28 | 18 |
| 46 | LWSGHSETGDATHLK | 11.41 | 413.47 | 569.34 | 24 |
| 47 | LWSGHSETGDATHLK | 11.41 | 550.95 | 719.85 | 32 |
| 48 | LWSGHSETGDATHLK | 11.41 | 550.95 | 1058.51 | 32 |
| 49 | NSFDGVSYWLAK | 20.75 | 693.84 | 767.41 | 36 |
| 50 | NSFDGVSYWLAK | 20.75 | 693.84 | 1038.53 | 36 |
| 51 | NSFDGVSYWLAK | 20.75 | 693.84 | 1185.59 | 36 |

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 13

Identification of a Resistance to KPC Beta-Lactams

The samples corresponding to a species able to comprise a KPC resistance mechanism can be detected by employing the following method.

Each sample is treated according to Example 5, then analysed according to Example 6 by detecting the peptides from TABLE 22 instead of the peptides from TABLE 3.

TABLE 22

| Transition number | Peptide | Retention time (minutes) | (m/z) filtered in Q1 | (m/z) filtered in Q3 | Collision energy (eV) |
|---|---|---|---|---|---|
| 1 | NALVR | 8.14 | 286.68 | 387.27 | 18 |
| 2 | NALVR | 8.14 | 286.68 | 398.24 | 18 |
| 3 | NALVR | 8.14 | 286.68 | 458.31 | 18 |
| 4 | TGTC[CAM]GAYGTANDYAVVWPTGR | 18.76 | 739.67 | 1169.45 | 41 |
| 5 | TGTC[CAM]GAYGTANDYAVVWPTGR | 18.76 | 1109.01 | 1163.58 | 54 |
| 6 | TGTC[CAM]GAYGTANDYAVVWPTGR | 18.76 | 1109.01 | 1169.45 | 54 |
| 7 | WELELNSAIPSDAR | 20.43 | 534.27 | 545.27 | 31 |
| 8 | WELELNSAIPSDAR | 20.43 | 800.9 | 930.46 | 40 |
| 9 | WELELNSAIPSDAR | 20.43 | 800.9 | 1043.55 | 40 |
| 10 | WELEMNSAIPGDAR | 19.35 | 794.87 | 900.45 | 40 |
| 11 | WELEMNSAIPGDAR | 19.35 | 794.87 | 1031.49 | 40 |
| 12 | WELEMNSAIPGDAR | 19.35 | 794.87 | 1074.49 | 40 |

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 14

Identification of a Resistance to NDM Beta-Lactams

The samples corresponding to a species able to comprise an NDM resistance mechanism can be detected by employing the following method.

Each sample is treated according to Example 5, then analysed according to Example 6 by detecting the peptides from TABLE 23 instead of the peptides from TABLE 3.

TABLE 23

| Transition number | Peptide | Retention time (minutes) | (m/Z) filtered in Q1 | (m/z) filtered in Q3 | Collision energy (eV) |
|---|---|---|---|---|---|
| 1 | VLLVDTAWTDDQTAQILNWIK | 27.87 | 815.1 | 914.55 | 45 |
| 2 | VLLVDTAWTDDQTAQILNWIK | 27.86 | 815.1 | 985.58 | 45 |
| 3 | VLLVDTAWTDDQTAQILNWIK | 27.85 | 815.1 | 1086.63 | 45 |

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 15

Identification of a Resistance to VIM Beta-Lactams

The samples corresponding to a species able to comprise a VIM resistance mechanism can be detected by employing the following method.

Each sample is treated according to Example 5, then analysed according to Example 6 by detecting the peptides from TABLE 24 instead of the peptides from TABLE 3.

TABLE 24

| Transition number | Peptide | Retention time (minutes) | (m/z) filtered in Q1 | (m/z) filtered in Q3 | Collision energy (eV) |
|---|---|---|---|---|---|
| 1 | LANEIPTHSLEGLSSSGDAVR | 16.72 | 718.37 | 778.37 | 40 |
| 2 | LANEIPTHSLEGLSSSGDAVR | 16.72 | 718.37 | 948.47 | 40 |
| 3 | LANEIPTHSLEGLSSSGDAVR | 16.72 | 718.37 | 1077.52 | 40 |

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 16

Identification of a Resistance to OXA Beta-Lactams

The samples corresponding to a species able to comprise an OXA resistance mechanism can be detected by employing the following method.

Each sample is treated according to Example 5, then analysed according to Example 6 by detecting the peptides from TABLE 25 instead of the peptides from TABLE 3.

TABLE 25

| Transition number | Peptide | Retention time (minutes) | (m/z) filtered in Q1 | (m/z) filtered in Q3 | Collision energy (eV) |
|---|---|---|---|---|---|
| 1 | AAAYELAENLFEAGQADGWR | 24.48 | 728.01 | 1249.6 | 40 |
| 2 | AAAYELAENLFEAGQADGWR | 24.48 | 1091.51 | 1193.58 | 53 |
| 3 | AAAYELAENLFEAGQADGWR | 24.48 | 1091.51 | 1249.6 | 53 |
| 4 | AAEGFIPASTFK | 17.74 | 619.82 | 763.43 | 32 |
| 5 | AAEGFIPASTFK | 17.74 | 619.82 | 910.5 | 32 |
| 6 | AAEGFIPASTFK | 17.74 | 619.82 | 967.52 | 32 |
| 7 | ADGQWAFALNMQMK | 21.27 | 811.91 | 982.48 | 41 |
| 8 | ADGQWAFALNMQMK | 21.29 | 811.91 | 1053.52 | 41 |
| 9 | ADGQWAFALNMQMK | 21.27 | 811.91 | 1152.59 | 41 |
| 10 | ADINEIFK | 17.3 | 475.25 | 650.35 | 26 |
| 11 | ADINEIFK | 17.3 | 475.25 | 763.43 | 26 |
| 12 | ADINEIFK | 17.3 | 475.25 | 878.46 | 26 |
| 13 | ADWGK | 6.9 | 288.64 | 390.21 | 18 |
| 14 | ADWGK | 6.91 | 288.64 | 430.17 | 18 |
| 15 | ADWGK | 6.89 | 288.64 | 505.24 | 18 |
| 16 | AEGAIVISDER | 13.52 | 387.2 | 419.19 | 23 |
| 17 | AEGAIVISDER | 13.53 | 387.2 | 506.22 | 23 |
| 18 | AEGAIVISDER | 13.52 | 387.2 | 619.3 | 23 |
| 19 | AFALNLDIDK | 20.16 | 560.31 | 717.38 | 30 |
| 20 | AFALNLDIDK | 20.16 | 560.31 | 830.46 | 30 |
| 21 | AFALNLDIDK | 20.16 | 560.31 | 901.5 | 30 |
| 22 | AFAPMSTFK | 16.96 | 500.25 | 710.35 | 27 |
| 23 | AFAPMSTFK | 16.96 | 500.25 | 781.39 | 27 |
| 24 | AFAPMSTFK | 16.96 | 500.25 | 928.46 | 27 |
| 25 | AFGYGNADVSGDPGQNNGLDR | 15.12 | 708.65 | 873.42 | 39 |
| 26 | AFGYGNADVSGDPGQNNGLDR | 15.12 | 708.65 | 970.47 | 39 |
| 27 | AFGYGNADVSGDPGQNNGLDR | 15.12 | 708.65 | 1154.47 | 39 |
| 28 | AFTMTK | 11.32 | 349.68 | 480.25 | 20 |
| 29 | AFTMTK | 11.33 | 349.68 | 552.25 | 20 |
| 30 | AFTMTK | 11.33 | 349.68 | 627.32 | 20 |
| 31 | AGDDIALR | 12.23 | 415.72 | 587.35 | 23 |
| 32 | AGDDIALR | 12.23 | 415.72 | 702.38 | 23 |
| 33 | AGDDIALR | 12.23 | 415.72 | 759.4 | 23 |
| 34 | AGHVYAFALNIDMPR | 20.63 | 558.95 | 631.32 | 32 |
| 35 | AGHVYAFALNIDMPR | 20.63 | 558.95 | 745.37 | 32 |
| 36 | AGHVYAFALNIDMPR | 20.63 | 558.95 | 817.4 | 32 |
| 37 | AGLWR | 13.44 | 301.67 | 361.2 | 18 |
| 38 | AGLWR | 13.44 | 301.67 | 474.28 | 18 |

TABLE 25-continued

| Transition number | Peptide | Retention time (minutes) | (m/z) filtered in Q1 | (m/z) filtered in Q3 | Collision energy (eV) |
|---|---|---|---|---|---|
| 39 | AGLWR | 13.44 | 301.67 | 531.3 | 18 |
| 40 | AHTEYVPASTFK | 13.18 | 450.89 | 553.3 | 27 |
| 41 | AHTEYVPASTFK | 13.18 | 450.89 | 602.26 | 27 |
| 42 | AHTEYVPASTFK | 13.18 | 450.89 | 650.35 | 27 |
| 43 | AIIPWDGKPR | 15.84 | 384.89 | 428.23 | 23 |
| 44 | AIIPWDGKPR | 15.84 | 384.89 | 457.29 | 23 |
| 45 | AIIPWDGKPR | 15.84 | 384.89 | 572.32 | 23 |
| 46 | AISDITITR | 14.8 | 495.28 | 603.38 | 27 |
| 47 | AISDITITR | 14.8 | 495.28 | 718.41 | 27 |
| 48 | AISDITITR | 14.8 | 495.28 | 805.44 | 27 |
| 49 | ALGQDR | 11.25 | 330.18 | 475.23 | 20 |
| 50 | ALGQDR | 11.25 | 330.18 | 485.24 | 20 |
| 51 | ALGQDR | 11.25 | 330.18 | 588.31 | 20 |
| 52 | ALQAK | 1.86 | 265.67 | 346.21 | 17 |
| 53 | ALQAK | 1.87 | 265.67 | 384.22 | 17 |
| 54 | ALQAK | 1.87 | 265.67 | 459.29 | 17 |
| 55 | AMETFSPASTFK | 17.06 | 658.81 | 737.38 | 34 |
| 56 | AMETFSPASTFK | 17.05 | 658.81 | 985.5 | 34 |
| 57 | AMETFSPASTFK | 17.06 | 658.81 | 1114.54 | 34 |
| 58 | AMLFLQER | 18.48 | 504.27 | 545.3 | 27 |
| 59 | AMLFLQER | 18.48 | 504.27 | 692.37 | 27 |
| 60 | AMLFLQER | 18.48 | 504.27 | 805.46 | 27 |
| 61 | AMLVFDPVR | 19.87 | 524.29 | 732.4 | 28 |
| 62 | AMLVFDPVR | 19.87 | 524.29 | 845.49 | 28 |
| 63 | AMLVFDPVR | 19.87 | 524.29 | 976.53 | 28 |
| 64 | AMTLLESGPGWELHGK | 19.32 | 575.96 | 923.47 | 33 |
| 65 | AMTLLESGPGWELHGK | 19.32 | 575.96 | 980.49 | 33 |
| 66 | AMTLLESGPGWELHGK | 19.32 | 575.96 | 1067.53 | 33 |
| 67 | ANLHITLHGK | 12.18 | 368.55 | 403.24 | 22 |
| 68 | ANLHITLHGK | 12.18 | 368.55 | 555.32 | 22 |
| 69 | ANLHITLHGK | 12.18 | 368.55 | 668.41 | 22 |
| 70 | ANQLIVK | 11.87 | 393.25 | 600.41 | 22 |
| 71 | ANQLIVK | 11.86 | 393.25 | 639.38 | 22 |
| 72 | ANQLIVK | 11.86 | 393.25 | 714.45 | 22 |
| 73 | ANTEYVPASTFK | 14.54 | 664.33 | 912.48 | 34 |
| 74 | ANTEYVPASTFK | 14.54 | 664.33 | 1041.53 | 34 |
| 75 | ANTEYVPASTFK | 14.54 | 664.33 | 1142.57 | 34 |
| 76 | ANVSR | 9.57 | 273.65 | 361.22 | 17 |

TABLE 25-continued

| Transition number | Peptide | Retention time (minutes) | (m/z) filtered in Q1 | (m/z) filtered in Q3 | Collision energy (eV) |
|---|---|---|---|---|---|
| 77 | ANVSR | 9.57 | 273.65 | 372.19 | 17 |
| 78 | ANVSR | 9.57 | 273.65 | 475.26 | 17 |
| 79 | APIGWFIGWATR | 25.58 | 687.87 | 850.46 | 35 |
| 80 | APIGWFIGWATR | 25.58 | 687.87 | 1093.56 | 35 |
| 81 | APIGWFIGWATR | 25.58 | 687.87 | 1206.64 | 35 |
| 82 | APLGWFIGWATHEER | 24.69 | 590.63 | 742.35 | 34 |
| 83 | APLGWFIGWATHEER | 24.69 | 590.63 | 985.45 | 34 |
| 84 | APLGWFIGWATHEER | 24.69 | 590.63 | 1098.53 | 34 |
| 85 | AQDEVQSMLFIEEK | 20.15 | 833.99 | 96.51 | 42 |
| 86 | AQDEVQSMLFIEEK | 20.14 | 833.91 | 124.57 | 42 |
| 87 | AQDEVQSMLFIEEK | 20.15 | 833.91 | 223.63 | 42 |
| 88 | AQGVIVLWNENK | 18.95 | 685.87 | 902.47 | 35 |
| 89 | AQGVIVLWNENK | 18.95 | 685.87 | 1015.56 | 35 |
| 90 | AQGVIVLWNENK | 18.95 | 685.87 | 1171.65 | 35 |
| 91 | ASAIAVYQDLAR | 18.05 | 639.35 | 765.39 | 33 |
| 92 | ASAIAVYQDLAR | 18.05 | 639.35 | 864.46 | 33 |
| 93 | ASAIAVYQDLAR | 18.05 | 639.35 | 935.49 | 33 |
| 94 | ASAILVYQDLAR | 19.08 | 660.37 | 765.39 | 34 |
| 95 | ASAILVYQDLAR | 19.08 | 660.37 | 864.46 | 34 |
| 96 | ASAILVYQDLAR | 19.08 | 660.37 | 977.54 | 34 |
| 97 | ASAIPVYQDLAR | 17.45 | 652.35 | 765.39 | 34 |
| 98 | ASAIPVYQDLAR | 17.45 | 652.35 | 864.46 | 34 |
| 99 | ASAIPVYQDLAR | 17.45 | 652.35 | 961.51 | 34 |
| 100 | ASAIPVYQDLPR | 17.59 | 665.36 | 791.4 | 34 |
| 101 | ASAIPVYQDLPR | 17.59 | 665.36 | 890.47 | 34 |
| 102 | ASAIPVYQDLPR | 17.6 | 665.36 | 987.53 | 34 |
| 103 | ASAIQVYQDLAR | 18.37 | 667.86 | 765.39 | 34 |
| 104 | ASAIQVYQDLAR | 18.37 | 667.86 | 864.46 | 34 |
| 105 | ASAIQVYQDLAR | 18.37 | 667.86 | 992.52 | 34 |
| 106 | ASAISVYQDLAR | 17.93 | 647.34 | 765.39 | 33 |
| 107 | ASAISVYQDLAR | 17.93 | 647.34 | 864.46 | 33 |
| 108 | ASAISVYQDLAR | 17.93 | 647.34 | 951.49 | 33 |
| 109 | ASALPVYQDLAR | 17.77 | 652.35 | 864.46 | 34 |
| 110 | ASALPVYQDLAR | 17.77 | 652.35 | 961.51 | 34 |
| 111 | ASALPVYQDLAR | 17.77 | 652.35 | 1074.59 | 34 |
| 112 | ASAMPVYQDLAR | 16.64 | 661.33 | 765.39 | 34 |
| 113 | ASAMPVYQDLAR | 16.64 | 661.33 | 864.46 | 34 |
| 114 | ASAMPVYQDLAR | 16.64 | 661.33 | 961.51 | 34 |

TABLE 25-continued

| Transition number | Peptide | Retention time (minutes) | (m/z) filtered in Q1 | (m/z) filtered in Q3 | Collision energy (eV) |
|---|---|---|---|---|---|
| 115 | ASAVPVYQDLAR | 16.29 | 645.35 | 765.39 | 33 |
| 116 | ASAVPVYQDLAR | 16.29 | 645.35 | 864.46 | 33 |
| 117 | ASAVPVYQDLAR | 16.29 | 645.35 | 961.51 | 33 |
| 118 | ASIEYVPASTFK | 16.7 | 656.84 | 749.42 | 34 |
| 119 | ASIEYVPASTFK | 16.7 | 656.84 | 912.48 | 34 |
| 120 | ASIEYVPASTFK | 16.7 | 656.84 | 1041.53 | 34 |
| 121 | ASNVPVYQELAR | 18.48 | 673.86 | 779.4 | 35 |
| 122 | ASNVPVYQELAR | 18.48 | 673.86 | 878.47 | 35 |
| 123 | ASNVPVYQELAR | 18.48 | 673.86 | 975.53 | 35 |
| 124 | ASPASTFK | 10.29 | 404.71 | 553.3 | 23 |
| 125 | ASPASTFK | 10.29 | 404.71 | 650.35 | 23 |
| 126 | ASPASTFK | 10.28 | 404.71 | 737.38 | 23 |
| 127 | ASTAYIPASTFK | 15.69 | 628.83 | 763.43 | 33 |
| 128 | ASTAYIPASTFK | 15.69 | 628.83 | 926.5 | 33 |
| 129 | ASTAYIPASTFK | 15.69 | 628.83 | 997.54 | 33 |
| 130 | ASTEYVPASTFK | 14.59 | 650.82 | 749.42 | 34 |
| 131 | ASTEYVPASTFK | 14.59 | 650.82 | 912.48 | 34 |
| 132 | ASTEYVPASTFK | 14.6 | 650.82 | 1041.53 | 34 |
| 133 | ASTTEVFK | 11.78 | 441.73 | 623.34 | 24 |
| 134 | ASTTEVFK | 11.78 | 441.73 | 724.39 | 24 |
| 135 | ASTTEVFK | 11.78 | 441.73 | 811.42 | 24 |
| 136 | ATSTEIFK | 13.15 | 448.74 | 637.36 | 25 |
| 137 | ATSTEIFK | 13.15 | 448.74 | 724.39 | 25 |
| 138 | ATSTEIFK | 13.15 | 448.74 | 825.44 | 25 |
| 139 | ATTNEIFK | 13.21 | 462.25 | 650.35 | 25 |
| 140 | ATTNEIFK | 13.21 | 462.25 | 751.4 | 25 |
| 141 | ATTNEIFK | 13.21 | 462.25 | 852.45 | 25 |
| 142 | ATTTAVFK | 11.9 | 419.74 | 464.29 | 23 |
| 143 | ATTTAVFK | 11.9 | 419.74 | 565.33 | 23 |
| 144 | ATTTAVFK | 11.9 | 419.74 | 666.38 | 23 |
| 145 | ATTTEIFK | 13.64 | 455.75 | 637.36 | 25 |
| 146 | ATTTEIFK | 13.65 | 455.75 | 738.4 | 25 |
| 147 | ATTTEIFK | 13.65 | 455.75 | 839.45 | 25 |
| 148 | ATTTEVFK | 11.98 | 448.74 | 623.34 | 25 |
| 149 | ATTTEVFK | 11.98 | 448.74 | 724.39 | 25 |
| 150 | ATTTEVFK | 11.98 | 448.74 | 825.44 | 25 |
| 151 | AVSDITILEQTDNYTLHGK | 19.19 | 706.7 | 974.49 | 39 |
| 152 | AVSDITILEQTDNYTLHGK | 19.19 | 706.7 | 1048.51 | 39 |

TABLE 25-continued

| Transition number | Peptide | Retention time (minutes) | (m/z) filtered in Q1 | (m/z) filtered in Q3 | Collision energy (eV) |
|---|---|---|---|---|---|
| 153 | AVSDITILEQTDNYTLHGK | 19.18 | 706.7 | 1176.56 | 39 |
| 154 | AVSDITILEQTYNYTLHGK | 22.29 | 722.71 | 995.49 | 40 |
| 155 | AVSDITILEQTYNYTLHGK | 22.29 | 722.71 | 998.5 | 40 |
| 156 | AVSDITILEQTYNYTLHGK | 22.28 | 722.71 | 1224.6 | 40 |
| 157 | AVVPHFEAGDWDVQGK | 17.81 | 585.62 | 743.34 | 33 |
| 158 | AVVPHFEAGDWDVQGK | 17.81 | 585.62 | 792.88 | 33 |
| 159 | AVVPHFEAGDWDVQGK | 17.81 | 585.62 | 904.42 | 33 |
| 160 | AWEHDMSLR | 13.99 | 572.76 | 758.36 | 30 |
| 161 | AWEHDMSLR | 13.99 | 572.76 | 887.4 | 30 |
| 162 | AWEHDMSLR | 13.99 | 572.76 | 1073.48 | 30 |
| 163 | AWIGSSLQISPLEQLEFLGK | 26.98 | 739.4 | 963.51 | 41 |
| 164 | AWIGSSLQISPLEQLEFLGK | 26.99 | 739.4 | 1173.65 | 41 |
| 165 | AWIGSSLQISPLEQLEFLGK | 26.98 | 1108.6 | 1173.65 | 54 |
| 166 | DAFLK | 12.42 | 297.17 | 407.27 | 18 |
| 167 | DAFLK | 12.43 | 297.17 | 447.22 | 18 |
| 168 | DAFLK | 12.42 | 297.17 | 478.3 | 18 |
| 169 | DDFILHGK | 13.99 | 472.75 | 714.43 | 26 |
| 170 | DDFILHGK | 13.99 | 472.75 | 798.38 | 26 |
| 171 | DDFILHGK | 13.99 | 472.75 | 829.46 | 26 |
| 172 | DDVLK | 8.62 | 295.16 | 359.27 | 18 |
| 173 | DDVLK | 8.63 | 295.16 | 443.21 | 18 |
| 174 | DDVLK | 8.62 | 295.16 | 474.29 | 18 |
| 175 | DEFHVFR | 15.39 | 475.23 | 705.38 | 26 |
| 176 | DEFHVFR | 15.39 | 475.23 | 775.34 | 26 |
| 177 | DEFHVFR | 15.39 | 475.23 | 834.43 | 26 |
| 178 | DEFQIFR | 19.02 | 477.74 | 520.2 | 26 |
| 179 | DEFQIFR | 19.02 | 477.74 | 563.33 | 26 |
| 180 | DEFQIFR | 19.02 | 477.74 | 710.4 | 26 |
| 181 | DEFQVFR | 17.29 | 470.73 | 549.31 | 26 |
| 182 | DEFQVFR | 17.28 | 470.73 | 619.27 | 26 |
| 183 | DEFQVFR | 17.29 | 470.73 | 696.38 | 26 |
| 184 | DELVR | 9.33 | 316.17 | 387.27 | 19 |
| 185 | DELVR | 9.35 | 316.17 | 457.23 | 19 |
| 186 | DELVR | 9.33 | 316.17 | 516.31 | 19 |
| 187 | DFDYGNQDFSGDK | 14.72 | 754.3 | 967.41 | 38 |
| 188 | DFDYGNQDFSGDK | 14.72 | 754.3 | 1130.47 | 38 |
| 189 | DFDYGNQDFSGDK | 14.72 | 754.3 | 1245.5 | 38 |
| 190 | DFTLGEAMQASTVPVYQELAR | 24.19 | 776.05 | 975.53 | 43 |

TABLE 25-continued

| Transition number | Peptide | Retention time (minutes) | (m/z) filtered in Q1 | (m/z) filtered in Q3 | Collision energy (eV) |
|---|---|---|---|---|---|
| 191 | DFTLGEAMQASTVPVYQELAR | 24.19 | 776.05 | 1074.59 | 43 |
| 192 | DFTLGEAMQASTVPVYQELAR | 24.19 | 1163.57 | 1175.64 | 56 |
| 193 | DHDLITAMK | 14.23 | 522.26 | 563.32 | 28 |
| 194 | DHDLITAMK | 14.23 | 522.26 | 695.34 | 28 |
| 195 | DHDLITAMK | 14.23 | 522.26 | 791.43 | 28 |
| 196 | DIAAWNR | 13.63 | 423.22 | 546.28 | 24 |
| 197 | DIAAWNR | 13.63 | 423.22 | 617.32 | 24 |
| 198 | DIAAWNR | 13.62 | 423.22 | 730.4 | 24 |
| 199 | DILYIQELAGGWK | 24.49 | 753.4 | 888.46 | 38 |
| 200 | DILYIQELAGGWK | 24.48 | 753.4 | 1001.54 | 38 |
| 201 | DILYIQELAGGWK | 24.49 | 753.4 | 1164.6 | 38 |
| 202 | DITILEK | 15.9 | 416.24 | 603.37 | 23 |
| 203 | DITILEK | 15.91 | 416.24 | 685.38 | 23 |
| 204 | DITILEK | 15.91 | 416.24 | 716.46 | 23 |
| 205 | DLLSAK | 12.45 | 323.69 | 429.23 | 19 |
| 206 | DLLSAK | 12.44 | 323.69 | 500.27 | 19 |
| 207 | DLLSAK | 12.45 | 323.69 | 531.35 | 19 |
| 208 | DLMITEAGR | 15.07 | 503.26 | 533.27 | 27 |
| 209 | DLMITEAGR | 15.07 | 503.26 | 646.35 | 27 |
| 210 | DLMITEAGR | 15.07 | 503.26 | 777.39 | 27 |
| 211 | DLMIVEAGR | 16.68 | 502.27 | 531.29 | 27 |
| 212 | DLMIVEAGR | 16.68 | 502.27 | 644.37 | 27 |
| 213 | DLMIVEAGR | 16.68 | 502.27 | 775.41 | 27 |
| 214 | DLMIVEAK | 16.23 | 459.75 | 473.24 | 25 |
| 215 | DLMIVEAK | 16.23 | 459.75 | 559.34 | 25 |
| 216 | DLMIVEAK | 16.23 | 459.75 | 690.39 | 25 |
| 217 | DLSGNPGK | 6.69 | 394.2 | 472.25 | 22 |
| 218 | DLSGNPGK | 6.69 | 394.2 | 559.28 | 22 |
| 219 | DLSGNPGK | 6.7 | 394.2 | 672.37 | 22 |
| 220 | DLSLR | 12.37 | 302.18 | 375.24 | 18 |
| 221 | DLSLR | 12.35 | 302.18 | 429.23 | 18 |
| 222 | DLSLR | 12.36 | 302.18 | 488.32 | 18 |
| 223 | DLTLR | 12.48 | 309.18 | 389.25 | 19 |
| 224 | DLTLR | 12.47 | 309.18 | 443.25 | 19 |
| 225 | DLTLR | 12.47 | 309.18 | 502.33 | 19 |
| 226 | DMTLGDAIK | 15.97 | 482.24 | 503.28 | 26 |
| 227 | DMTLGDAIK | 15.97 | 482.24 | 616.37 | 26 |
| 228 | DMTLGDAIK | 15.97 | 482.24 | 717.41 | 26 |

TABLE 25-continued

| Transition number | Peptide | Retention time (minutes) | (m/z) filtered in Q1 | (m/z) filtered in Q3 | Collision energy (eV) |
|---|---|---|---|---|---|
| 229 | DMTLGDAMALSAVPVYQELAR | 25.76 | 751.04 | 975.53 | 42 |
| 230 | DMTLGDAMALSAVPVYQELAR | 25.76 | 1126.06 | 1145.63 | 55 |
| 231 | DMTLGDAMALSAVPVYQELAR | 25.75 | 1126.06 | 1232.66 | 55 |
| 232 | DMTLGDAMK | 14.46 | 491.22 | 634.32 | 27 |
| 233 | DMTLGDAMK | 14.46 | 491.22 | 735.37 | 27 |
| 234 | DMTLGDAMK | 14.46 | 491.22 | 866.41 | 27 |
| 235 | DMTLGEAMALSAVPVYQDLAR | 25.92 | 751.04 | 961.51 | 42 |
| 236 | DMTLGEAMALSAVPVYQDLAR | 25.92 | 1126.06 | 1131.62 | 55 |
| 237 | DMTLGEAMALSAVPVYQDLAR | 25.92 | 1126.06 | 1218.65 | 55 |
| 238 | DMTLGEAMALSAVPVYQELAR | 26.48 | 755.71 | 779.4 | 42 |
| 239 | DMTLGEAMALSAVPVYQELAR | 26.48 | 755.71 | 975.53 | 42 |
| 240 | DMTLGEAMALSAVPVYQELAR | 26.47 | 1133.07 | 1232.66 | 55 |
| 241 | DMTLGEAMK | 15.09 | 498.23 | 535.25 | 27 |
| 242 | DMTLGEAMK | 15.09 | 498.23 | 648.34 | 27 |
| 243 | DMTLGEAMK | 15.09 | 498.23 | 749.39 | 27 |
| 244 | DMTLGQAMQASAVPVYQELAR | 23.29 | 760.38 | 779.4 | 42 |
| 245 | DMTLGQAMQASAVPVYQELAR | 23.29 | 760.38 | 975.53 | 42 |
| 246 | DMTLGQAMQASAVPVYQELAR | 23.29 | 760.38 | 976.42 | 42 |
| 247 | DQDLR | 2.54 | 323.66 | 403.23 | 19 |
| 248 | DQDLR | 2.55 | 323.66 | 472.2 | 19 |
| 249 | DQDLR | 2.55 | 323.66 | 531.29 | 19 |
| 250 | DQQIGWFVGWASKPGK | 21.64 | 601.98 | 830.45 | 34 |
| 251 | DQQIGWFVGWASKPGK | 21.64 | 902.46 | 929.52 | 45 |
| 252 | DQQIGWFVGWASKPGK | 21.64 | 902.46 | 1076.59 | 45 |
| 253 | DQQVQVYGNDLNR | 13.59 | 774.87 | 851.4 | 39 |
| 254 | DQQVQVYGNDLNR | 13.58 | 774.87 | 950.47 | 39 |
| 255 | DQQVQVYGNDLNR | 13.59 | 774.87 | 1078.53 | 39 |
| 256 | DQTLESAFK | 15.21 | 519.76 | 581.29 | 28 |
| 257 | DQTLESAFK | 15.21 | 519.76 | 694.38 | 28 |
| 258 | DQTLESAFK | 15.21 | 519.76 | 795.42 | 28 |
| 259 | DSIVWYSQELTR | 19.61 | 748.87 | 896.45 | 38 |
| 260 | DSIVWYSQELTR | 19.61 | 748.87 | 1082.53 | 38 |
| 261 | DSIVWYSQELTR | 19.61 | 748.87 | 1181.59 | 38 |
| 262 | DSIVWYSQQLTR | 19.1 | 748.38 | 895.46 | 38 |
| 263 | DSIVWYSQQLTR | 19.11 | 748.38 | 1081.54 | 38 |
| 264 | DSIVWYSQQLTR | 19.1 | 748.38 | 1180.61 | 38 |
| 265 | DSNLR | 1.77 | 302.66 | 402.25 | 18 |
| 266 | DSNLR | 1.77 | 302.66 | 430.19 | 18 |

TABLE 25-continued

| Transition number | Peptide | Retention time (minutes) | (m/z) filtered in Q1 | (m/z) filtered in Q3 | Collision energy (eV) |
|---|---|---|---|---|---|
| 267 | DSNLR | 1.77 | 302.66 | 489.28 | 18 |
| 268 | DSYIAWGGEAWK | 19.67 | 691.82 | 833.39 | 35 |
| 269 | DSYIAWGGEAWK | 19.67 | 691.82 | 904.43 | 35 |
| 270 | DSYIAWGGEAWK | 19.66 | 691.82 | 1017.52 | 35 |
| 271 | DTLNPEWPYK | 17.3 | 631.81 | 819.4 | 33 |
| 272 | DTLNPEWPYK | 17.3 | 631.81 | 933.45 | 33 |
| 273 | DTLNPEWPYK | 17.3 | 631.81 | 1046.53 | 33 |
| 274 | DVDEVFYK | 15.62 | 507.74 | 685.36 | 27 |
| 275 | DVDEVFYK | 15.62 | 507.74 | 800.38 | 27 |
| 276 | DVDEVFYK | 15.62 | 507.74 | 899.45 | 27 |
| 277 | DWILR | 17.44 | 351.7 | 415.2 | 20 |
| 278 | DWILR | 17.44 | 351.7 | 528.28 | 20 |
| 279 | DWILR | 17.44 | 351.7 | 587.37 | 20 |
| 280 | EAFLR | 12.51 | 318.18 | 435.27 | 19 |
| 281 | EAFLR | 12.51 | 318.18 | 461.24 | 19 |
| 282 | EAFLR | 12.51 | 318.18 | 506.31 | 19 |
| 283 | EAIVR | 7.84 | 294.18 | 387.27 | 18 |
| 284 | EAIVR | 7.84 | 294.18 | 413.24 | 18 |
| 285 | EAIVR | 7.84 | 294.18 | 458.31 | 18 |
| 286 | EAIVTEATPEYIVHSK | 16.43 | 596.31 | 746.42 | 34 |
| 287 | EAIVTEATPEYIVHSK | 16.43 | 596.31 | 972.51 | 34 |
| 288 | EAIVTEATPEYIVHSK | 16.42 | 596.31 | 1073.56 | 34 |
| 289 | EALVTEAAPEYLVHSK | 17.3 | 586.31 | 875.46 | 33 |
| 290 | EALVTEAAPEYLVHSK | 17.3 | 586.31 | 972.51 | 33 |
| 291 | EALVTEAAPEYLVHSK | 17.3 | 586.31 | 1114.59 | 33 |
| 292 | EALVTEAPEYLVHSK | 17.58 | 562.63 | 637.32 | 32 |
| 293 | EALVTEAPEYLVHSK | 17.58 | 562.63 | 972.51 | 32 |
| 294 | EALVTEAPEYLVHSK | 17.58 | 562.63 | 1043.55 | 32 |
| 295 | EEIVR | 8.41 | 323.18 | 387.27 | 19 |
| 296 | EEIVR | 8.4 | 323.18 | 471.24 | 19 |
| 297 | EEIVR | 8.4 | 323.18 | 516.31 | 19 |
| 298 | EEVLAALPAQLK | 19.48 | 641.37 | 740.47 | 33 |
| 299 | EEVLAALPAQLK | 19.47 | 641.37 | 811.5 | 33 |
| 300 | EEVLAALPAQLK | 19.47 | 641.37 | 924.59 | 33 |
| 301 | EFSAEAVNGVFVLC[CAM]K | 21.1 | 835.42 | 936.5 | 42 |
| 302 | EFSAEAVNGVFVLC[CAM]K | 21.1 | 835.42 | 1106.6 | 42 |
| 303 | EFSAEAVNGVFVLC[CAM]K | 21.1 | 835.42 | 1235.65 | 42 |
| 304 | EFSSESVHGVFVLC[CAM]K | 18.26 | 575.62 | 666.36 | 33 |

TABLE 25-continued

| Transition number | Peptide | Retention time (minutes) | (m/z) filtered in Q1 | (m/z) filtered in Q3 | Collision energy (eV) |
| --- | --- | --- | --- | --- | --- |
| 305 | EFSSESVHGVFVLC[CAM]K | 18.26 | 575.62 | 822.45 | 33 |
| 306 | EFSSESVHGVFVLC[CAM]K | 18.26 | 575.62 | 959.51 | 33 |
| 307 | EGMSGSIR | 9.88 | 418.7 | 432.26 | 23 |
| 308 | EGMSGSIR | 9.88 | 418.7 | 519.29 | 23 |
| 309 | EGMSGSIR | 9.88 | 418.7 | 707.35 | 23 |
| 310 | EGMTGSIR | 10.63 | 425.71 | 432.26 | 24 |
| 311 | EGMTGSIR | 10.63 | 425.71 | 533.3 | 24 |
| 312 | EGMTGSIR | 10.63 | 425.71 | 664.34 | 24 |
| 313 | EIAVWNR | 14.78 | 444.24 | 475.24 | 25 |
| 314 | EIAVWNR | 14.77 | 444.24 | 574.31 | 25 |
| 315 | EIAVWNR | 14.77 | 444.24 | 645.35 | 25 |
| 316 | EIAYK | 8.46 | 312.17 | 381.21 | 19 |
| 317 | EIAYK | 8.46 | 312.17 | 477.23 | 19 |
| 318 | EIAYK | 8.46 | 312.17 | 494.3 | 19 |
| 319 | EIFER | 11.7 | 347.18 | 451.23 | 20 |
| 320 | EIFER | 11.7 | 347.18 | 519.24 | 20 |
| 321 | EIFER | 11.7 | 347.18 | 564.31 | 20 |
| 322 | EIFYHYR | 13.31 | 514.25 | 785.37 | 28 |
| 323 | EIFYHYR | 13.31 | 514.25 | 853.39 | 28 |
| 324 | EIFYHYR | 13.32 | 514.25 | 898.46 | 28 |
| 325 | EIGDDK | 1.99 | 338.66 | 434.19 | 20 |
| 326 | EIGDDK | 1.99 | 338.66 | 530.21 | 20 |
| 327 | EIGDDK | 1.99 | 338.66 | 547.27 | 20 |
| 328 | EIGDGK | 1.76 | 309.66 | 376.18 | 19 |
| 329 | EIGDGK | 1.75 | 309.66 | 472.2 | 19 |
| 330 | EIGDGK | 1.75 | 309.66 | 489.27 | 19 |
| 331 | EIGEDK | 2.32 | 345.67 | 448.2 | 20 |
| 332 | EIGEDK | 2.33 | 345.67 | 544.22 | 20 |
| 333 | EIGEDK | 2.33 | 345.67 | 561.29 | 20 |
| 334 | EIGEDNAR | 10.05 | 452.21 | 604.27 | 25 |
| 335 | EIGEDNAR | 10.05 | 452.21 | 661.29 | 25 |
| 336 | EIGEDNAR | 10.06 | 452.21 | 774.37 | 25 |
| 337 | EIGENK | 1.86 | 345.18 | 447.22 | 20 |

TABLE 25-continued

| Transition number | Peptide | Retention time (minutes) | (m/z) filtered in Q1 | (m/z) filtered in Q3 | Collision energy (eV) |
|---|---|---|---|---|---|
| 338 | EIGENK | 1.86 | 345.18 | 543.24 | 20 |
| 339 | EIGENK | 1.86 | 345.18 | 560.3 | 20 |
| 340 | EIGSEIDK | 11.04 | 445.73 | 591.3 | 25 |
| 341 | EIGSEIDK | 11.04 | 445.73 | 648.32 | 25 |
| 342 | EIGSEIDK | 11.04 | 445.73 | 761.4 | 25 |
| 343 | EMIYLK | 15.11 | 398.72 | 536.34 | 23 |
| 344 | EMIYLK | 15.11 | 398.72 | 650.32 | 23 |
| 345 | EMIYLK | 15.11 | 398.72 | 667.38 | 23 |
| 346 | EMLYVER | 14.12 | 470.23 | 566.29 | 26 |
| 347 | EMLYVER | 14.12 | 470.23 | 679.38 | 26 |
| 348 | EMLYVER | 14.12 | 470.23 | 810.42 | 26 |
| 349 | ENIEK | 11.07 | 316.67 | 389.24 | 19 |
| 350 | ENIEK | 11.07 | 316.67 | 486.22 | 19 |
| 351 | ENIEK | 11.07 | 316.67 | 503.28 | 19 |
| 352 | ENQLIVK | 12.15 | 422.25 | 472.35 | 24 |
| 353 | ENQLIVK | 12.15 | 422.25 | 600.41 | 24 |
| 354 | ENQLIVK | 12.15 | 422.25 | 714.45 | 24 |
| 355 | EQAILLFR | 19.88 | 495.29 | 548.36 | 27 |
| 356 | EQAILLFR | 19.88 | 495.29 | 661.44 | 27 |
| 357 | EQAILLFR | 19.88 | 495.29 | 732.48 | 27 |
| 358 | EQIQFLLR | 19.45 | 523.8 | 548.36 | 28 |
| 359 | EQIQFLLR | 19.45 | 523.8 | 676.41 | 28 |
| 360 | EQIQFLLR | 19.45 | 523.8 | 789.5 | 28 |
| 361 | EQLAFDPQVQQQVK | 16.43 | 829.43 | 954.54 | 41 |
| 362 | EQLAFDPQVQQQVK | 16.42 | 829.43 | 1069.56 | 41 |
| 363 | EQLAFDPQVQQQVK | 16.42 | 829.43 | 1216.63 | 41 |
| 364 | EQVDFVQR | 13.09 | 510.76 | 549.31 | 27 |
| 365 | EQVDFVQR | 13.09 | 510.76 | 664.34 | 27 |
| 366 | EQVDFVQR | 13.09 | 510.76 | 763.41 | 27 |
| 367 | EVGEIR | 9.35 | 351.69 | 474.27 | 20 |
| 368 | EVGEIR | 9.35 | 351.69 | 528.27 | 20 |
| 369 | EVGEIR | 9.35 | 351.69 | 573.34 | 20 |
| 370 | EVGEVR | 6.91 | 344.68 | 460.25 | 20 |
| 371 | EVGEVR | 6.91 | 344.68 | 514.25 | 20 |
| 372 | EVGEVR | 6.91 | 344.68 | 559.32 | 20 |
| 373 | EYLPASTFK | 15.41 | 528.27 | 553.3 | 28 |
| 374 | EYLPASTFK | 15.41 | 528.27 | 650.35 | 28 |
| 375 | EYLPASTFK | 15.41 | 528.27 | 763.43 | 28 |

TABLE 25-continued

| Transition number | Peptide | Retention time (minutes) | (m/z) filtered in Q1 | (m/z) filtered in Q3 | Collision energy (eV) |
|---|---|---|---|---|---|
| 376 | EYLPVSTFK | 17.16 | 542.29 | 581.33 | 29 |
| 377 | EYLPVSTFK | 17.16 | 542.29 | 678.38 | 29 |
| 378 | EYLPVSTFK | 17.16 | 542.29 | 791.47 | 29 |
| 379 | EYNTSGTFVFYDGK | 18.2 | 814.37 | 1033.5 | 41 |
| 380 | EYNTSGTFVFYDGK | 18.2 | 814.37 | 1120.53 | 41 |
| 381 | EYNTSGTFVFYDGK | 18.2 | 814.37 | 1221.58 | 41 |
| 382 | EYVPASTFK | 13.89 | 521.27 | 553.3 | 28 |
| 383 | EYVPASTFK | 13.89 | 521.27 | 650.35 | 28 |
| 384 | EYVPASTFK | 13.89 | 521.27 | 749.42 | 28 |
| 385 | FAPESTFK | 13.67 | 463.73 | 482.26 | 25 |
| 386 | FAPESTFK | 13.67 | 463.73 | 611.3 | 25 |
| 387 | FAPESTFK | 13.67 | 463.73 | 708.36 | 25 |
| 388 | FAQYAK | 9.39 | 364.19 | 509.27 | 21 |
| 389 | FAQYAK | 9.39 | 364.19 | 580.31 | 21 |
| 390 | FAQYAK | 9.39 | 364.19 | 581.27 | 21 |
| 391 | FDYGNR | 10.1 | 386.17 | 509.25 | 22 |
| 392 | FDYGNR | 10.1 | 386.17 | 597.23 | 22 |
| 393 | FDYGNR | 10.09 | 386.17 | 624.27 | 22 |
| 394 | FEDLYK | 13.52 | 407.7 | 423.26 | 23 |
| 395 | FEDLYK | 13.52 | 407.7 | 538.29 | 23 |
| 396 | FEDLYK | 13.52 | 407.7 | 667.33 | 23 |
| 397 | FEDTFHISNQK | 14.33 | 455.89 | 476.25 | 27 |
| 398 | FEDTFHISNQK | 14.33 | 455.89 | 589.33 | 27 |
| 399 | FEDTFHISNQK | 14.33 | 455.89 | 726.39 | 27 |
| 400 | FEDTFHTSNQQHEK | 10.66 | 583.26 | 870.41 | 33 |
| 401 | FEDTFHTSNQQHEK | 10.66 | 583.26 | 971.45 | 33 |
| 402 | FEDTFHTSNQQHEK | 10.66 | 583.26 | 1108.51 | 33 |
| 403 | FEYGNQDVSGDSGK | 11.95 | 751.82 | 764.34 | 38 |
| 404 | FEYGNQDVSGDSGK | 11.95 | 751.82 | 1063.47 | 38 |
| 405 | FEYGNQDVSGDSGK | 11.95 | 751.82 | 1226.53 | 38 |
| 406 | FFSDFQAK | 16 | 495.24 | 608.3 | 27 |
| 407 | FFSDFQAK | 16 | 495.24 | 695.34 | 27 |
| 408 | FFSDFQAK | 16 | 495.24 | 842.4 | 27 |
| 409 | FFSDLQAEGAIVIADER | 20.44 | 627.65 | 1143.6 | 35 |
| 410 | FFSDLQAEGAIVIADER | 20.43 | 940.97 | 1143.6 | 46 |
| 411 | FFSDLQAEGAIVIADER | 20.44 | 940.97 | 1179.57 | 46 |
| 412 | FFSDLR | 15.38 | 392.7 | 490.26 | 22 |
| 413 | FFSDLR | 15.38 | 392.7 | 610.29 | 22 |

TABLE 25-continued

| Transition number | Peptide | Retention time (minutes) | (m/z) filtered in Q1 | (m/z) filtered in Q3 | Collision energy (eV) |
|---|---|---|---|---|---|
| 414 | FFSDLR | 15.38 | 392.7 | 637.33 | 22 |
| 415 | FFSEFQAK | 16.13 | 502.25 | 622.32 | 27 |
| 416 | FFSEFQAK | 16.13 | 502.25 | 709.35 | 27 |
| 417 | FFSEFQAK | 16.13 | 502.25 | 856.42 | 27 |
| 418 | FGLEGQLR | 15.8 | 460.25 | 473.28 | 25 |
| 419 | FGLEGQLR | 15.8 | 460.25 | 602.33 | 25 |
| 420 | FGLEGQLR | 15.8 | 460.25 | 772.43 | 25 |
| 421 | FLESLYLNNLPASK | 20.75 | 804.94 | 856.49 | 40 |
| 422 | FLESLYLNNLPASK | 20.75 | 804.94 | 1019.55 | 40 |
| 423 | FLESLYLNNLPASK | 20.75 | 804.94 | 1219.67 | 40 |
| 424 | FLLEGQLR | 18.06 | 488.28 | 602.33 | 26 |
| 425 | FLLEGQLR | 18.06 | 488.28 | 715.41 | 26 |
| 426 | FLLEGQLR | 18.06 | 488.28 | 828.49 | 26 |
| 427 | FQQYVDR | 11.19 | 478.24 | 552.28 | 26 |
| 428 | FQQYVDR | 11.19 | 478.24 | 680.34 | 26 |
| 429 | FQQYVDR | 11.19 | 478.24 | 808.39 | 26 |
| 430 | FSDYVQR | 11.83 | 457.72 | 565.31 | 25 |
| 431 | FSDYVQR | 11.83 | 457.72 | 680.34 | 25 |
| 432 | FSDYVQR | 11.83 | 457.72 | 767.37 | 25 |
| 433 | FSTASTFK | 12.71 | 444.73 | 553.3 | 25 |
| 434 | FSTASTFK | 12.7 | 444.73 | 654.35 | 25 |
| 435 | FSTASTFK | 12.7 | 444.73 | 741.38 | 25 |
| 436 | FSWDGK | 14.32 | 370.17 | 505.24 | 21 |
| 437 | FSWDGK | 14.32 | 370.17 | 592.27 | 21 |
| 438 | FSWDGK | 14.32 | 370.17 | 593.24 | 21 |
| 439 | FSYGNQNISGGIDK | 14.61 | 750.36 | 803.43 | 38 |
| 440 | FSYGNQNISGGIDK | 14.61 | 750.36 | 1045.53 | 38 |
| 441 | FSYGNQNISGGIDK | 14.61 | 750.36 | 1102.55 | 38 |
| 442 | FSYGNQNISGGTDK | 12.74 | 744.34 | 791.39 | 38 |
| 443 | FSYGNQNISGGTDK | 12.74 | 744.34 | 1033.49 | 38 |
| 444 | FSYGNQNISGGTDK | 12.74 | 744.34 | 1090.51 | 38 |
| 445 | FSYGSQNISGGIDK | 14.74 | 736.85 | 803.43 | 37 |
| 446 | FSYGSQNISGGIDK | 14.74 | 736.85 | 1075.54 | 37 |
| 447 | FSYGSQNISGGIDK | 14.75 | 736.85 | 1238.6 | 37 |
| 448 | FTEYVK | 11.81 | 393.71 | 538.29 | 22 |
| 449 | FTEYVK | 11.81 | 393.71 | 639.33 | 22 |
| 450 | FTEYVK | 11.81 | 393.71 | 640.3 | 22 |
| 451 | FVPASTYK | 11.76 | 456.74 | 498.26 | 25 |

TABLE 25-continued

| Transition number | Peptide | Retention time (minutes) | (m/z) filtered in Q1 | (m/z) filtered in Q3 | Collision energy (eV) |
|---|---|---|---|---|---|
| 452 | FVPASTYK | 11.76 | 456.74 | 569.29 | 25 |
| 453 | FVPASTYK | 11.77 | 456.74 | 666.35 | 25 |
| 454 | FVYDLAQGQLPFKPEVQQQVK | 20.48 | 821.44 | 955.52 | 45 |
| 455 | FVYDLAQGQLPFKPEVQQQVK | 20.48 | 821.44 | 1108.59 | 45 |
| 456 | FVYDLAQGQLPFKPEVQQQVK | 20.49 | 821.44 | 1109.07 | 45 |
| 457 | FWLEDQLR | 20.39 | 553.79 | 660.33 | 29 |
| 458 | FWLEDQLR | 20.39 | 553.79 | 773.42 | 29 |
| 459 | FWLEDQLR | 20.38 | 553.79 | 959.49 | 29 |
| 460 | FWLEGPLK | 20.63 | 495.28 | 543.31 | 27 |
| 461 | FWLEGPLK | 20.63 | 495.28 | 656.4 | 27 |
| 462 | FWLEGPLK | 20.63 | 495.28 | 842.48 | 27 |
| 463 | FWLEGQLR | 19.49 | 524.78 | 602.33 | 28 |
| 464 | FWLEGQLR | 19.49 | 524.78 | 715.41 | 28 |
| 465 | FWLEGQLR | 19.48 | 524.78 | 901.49 | 28 |
| 466 | FYPASSFK | 14.74 | 473.74 | 636.34 | 26 |
| 467 | FYPASSFK | 14.74 | 473.74 | 799.4 | 26 |
| 468 | FYPASSFK | 14.74 | 473.74 | 800.36 | 26 |
| 469 | FYPASTFK | 14.98 | 480.74 | 553.3 | 26 |
| 470 | FYPASTFK | 14.99 | 480.74 | 650.35 | 26 |
| 471 | FYPASTFK | 14.98 | 480.74 | 813.41 | 26 |
| 472 | GAIQVSAVPVFQQIAR | 21.6 | 842.48 | 958.55 | 42 |
| 473 | GAIQVSAVPVFQQIAR | 21.6 | 842.48 | 1057.62 | 42 |
| 474 | GAIQVSAVPVFQQIAR | 21.59 | 842.48 | 1128.65 | 42 |
| 475 | GAIQVSAVPVFQQITR | 21.52 | 857.49 | 988.56 | 43 |
| 476 | GAIQVSAVPVFQQITR | 21.51 | 857.49 | 1087.63 | 43 |
| 477 | GAIQVSAVPVFQQITR | 21.52 | 857.49 | 1158.66 | 43 |
| 478 | GELPVSEDALEMTK | 18.1 | 759.87 | 936.43 | 38 |
| 479 | GELPVSEDALEMTK | 18.11 | 759.87 | 1023.47 | 38 |
| 480 | GELPVSEDALEMTK | 18.11 | 759.87 | 1122.53 | 38 |
| 481 | GISSSVR | 8.65 | 353.2 | 448.25 | 21 |
| 482 | GISSSVR | 8.65 | 353.2 | 535.28 | 21 |
| 483 | GISSSVR | 8.67 | 353.2 | 648.37 | 21 |
| 484 | GNQTLVFAR | 14.83 | 503.28 | 605.38 | 27 |
| 485 | GNQTLVFAR | 14.83 | 503.28 | 706.42 | 27 |
| 486 | GNQTLVFAR | 14.83 | 503.28 | 834.48 | 27 |
| 487 | GPLEISAFEEAR | 18.95 | 659.84 | 809.38 | 34 |
| 488 | GPLEISAFEEAR | 18.94 | 659.84 | 922.46 | 34 |
| 489 | GPLEISAFEEAR | 18.94 | 659.84 | 1051.51 | 34 |

TABLE 25-continued

| Transition number | Peptide | Retention time (minutes) | (m/z) filtered in Q1 | (m/z) filtered in Q3 | Collision energy (eV) |
|---|---|---|---|---|---|
| 490 | GPLTITPIQEVK | 18.14 | 648.38 | 814.47 | 34 |
| 491 | GPLTITPIQEVK | 18.15 | 648.38 | 927.55 | 34 |
| 492 | GPLTITPIQEVK | 18.14 | 648.38 | 1028.6 | 34 |
| 493 | GSLLLWDQK | 19.61 | 530.3 | 576.28 | 28 |
| 494 | GSLLLWDQK | 19.61 | 530.3 | 689.36 | 28 |
| 495 | GSLLLWDQK | 19.61 | 530.3 | 802.45 | 28 |
| 496 | GTFVLYDVQR | 17.93 | 599.32 | 680.34 | 31 |
| 497 | GTFVLYDVQR | 17.93 | 599.32 | 793.42 | 31 |
| 498 | GTFVLYDVQR | 17.93 | 599.32 | 892.49 | 31 |
| 499 | GTIVVADER | 11.82 | 480.26 | 490.23 | 26 |
| 500 | GTIVVADER | 11.82 | 480.26 | 589.29 | 26 |
| 501 | GTIVVADER | 11.82 | 480.26 | 688.36 | 26 |
| 502 | GTIVVLDAR | 15.77 | 472.28 | 573.34 | 26 |
| 503 | GTIVVLDAR | 15.77 | 472.28 | 672.4 | 26 |
| 504 | GTIVVLDAR | 15.77 | 472.28 | 785.49 | 26 |
| 505 | GTIVVVDER | 13.6 | 494.28 | 518.26 | 27 |
| 506 | GTIVVVDER | 13.6 | 494.28 | 617.33 | 27 |
| 507 | GTIVVVDER | 13.6 | 494.28 | 716.39 | 27 |
| 508 | GTLPFSAR | 14.96 | 424.73 | 577.31 | 24 |
| 509 | GTLPFSAR | 14.96 | 424.73 | 690.39 | 24 |
| 510 | GTLPFSAR | 14.97 | 424.73 | 791.44 | 24 |
| 511 | HIADSK | 11.91 | 335.68 | 420.21 | 20 |
| 512 | HIADSK | 11.9 | 335.68 | 524.25 | 20 |
| 513 | HIADSK | 11.91 | 335.68 | 533.29 | 20 |
| 514 | HNGTDGAWIISSLR | 19.36 | 509.6 | 575.35 | 29 |
| 515 | HNGTDGAWIISSLR | 19.35 | 509.6 | 653.26 | 29 |
| 516 | HNGTDGAWIISSLR | 19.36 | 509.6 | 688.44 | 29 |
| 517 | HTLSVFDQER | 14.25 | 411.21 | 432.22 | 25 |
| 518 | HTLSVFDQER | 14.25 | 411.21 | 547.25 | 25 |
| 519 | HTLSVFDQER | 14.25 | 411.21 | 694.32 | 25 |
| 520 | HVTFASFR | 14.36 | 322.17 | 338.18 | 20 |
| 521 | HVTFASFR | 14.36 | 322.17 | 409.22 | 20 |
| 522 | HVTFASFR | 14.36 | 322.17 | 485.25 | 20 |
| 523 | IAISLMGYDAGFLR | 23.93 | 763.91 | 898.44 | 39 |
| 524 | IAISLMGYDAGFLR | 23.93 | 763.91 | 1029.48 | 39 |
| 525 | IAISLMGYDAGFLR | 23.94 | 763.91 | 1229.6 | 39 |
| 526 | IALSLMGFDSGILK | 24.91 | 732.91 | 836.45 | 37 |
| 527 | IALSLMGFDSGILK | 24.91 | 732.91 | 967.49 | 37 |

TABLE 25-continued

| Transition number | Peptide | Retention time (minutes) | (m/z) filtered in Q1 | (m/z) filtered in Q3 | Collision energy (eV) |
|---|---|---|---|---|---|
| 528 | IALSLMGFDSGILK | 24.91 | 732.91 | 1167.61 | 37 |
| 529 | IANALIGLENHK | 15.95 | 431.58 | 697.36 | 26 |
| 530 | IANALIGLENHK | 15.95 | 646.87 | 697.36 | 33 |
| 531 | IANALIGLENHK | 15.95 | 646.87 | 810.45 | 33 |
| 532 | IDTFWLDNSLK | 21.79 | 676.35 | 689.38 | 35 |
| 533 | IDTFWLDNSLK | 21.79 | 676.35 | 875.46 | 35 |
| 534 | IDTFWLDNSLK | 21.79 | 676.35 | 1123.58 | 35 |
| 535 | IDYYNLDR | 14.85 | 536.26 | 680.34 | 29 |
| 536 | IDYYNLDR | 14.85 | 536.26 | 843.4 | 29 |
| 537 | IDYYNLDR | 14.85 | 536.26 | 958.43 | 29 |
| 538 | IFNALIALDSGVIK | 24.74 | 737.44 | 802.47 | 37 |
| 539 | IFNALIALDSGVIK | 24.74 | 737.44 | 915.55 | 37 |
| 540 | IFNALIALDSGVIK | 24.74 | 737.44 | 1028.64 | 37 |
| 541 | IFNSLLALDSGALDNER | 22.76 | 924.48 | 976.43 | 46 |
| 542 | IFNSLLALDSGALDNER | 22.77 | 924.48 | 1089.52 | 46 |
| 543 | IFNSLLALDSGALDNER | 22.76 | 924.48 | 1160.55 | 46 |
| 544 | IFNTLIGLENGIVK | 23.29 | 765.95 | 829.48 | 39 |
| 545 | IFNTLIGLENGIVK | 23.3 | 765.95 | 942.56 | 39 |
| 546 | IFNTLIGLENGIVK | 23.3 | 765.95 | 1055.65 | 39 |
| 547 | IGLDLMQK | 17.7 | 459.26 | 634.32 | 25 |
| 548 | IGLDLMQK | 17.7 | 459.26 | 747.41 | 25 |
| 549 | IGLDLMQK | 17.7 | 459.26 | 804.43 | 25 |
| 550 | IGLEK | 8.54 | 280.18 | 389.24 | 17 |
| 551 | IGLEK | 8.55 | 280.18 | 413.24 | 17 |
| 552 | IGLEK | 8.54 | 280.18 | 446.26 | 17 |
| 553 | IGLELMQQEVQR | 18.73 | 722.38 | 787.41 | 37 |
| 554 | IGLELMQQEVQR | 18.73 | 722.38 | 918.45 | 37 |
| 555 | IGLELMQQEVQR | 18.73 | 722.38 | 1031.53 | 37 |
| 556 | IGLELMSK | 17.52 | 445.75 | 478.27 | 25 |
| 557 | IGLELMSK | 17.52 | 445.75 | 720.4 | 25 |
| 558 | IGLELMSK | 17.52 | 445.75 | 777.42 | 25 |
| 559 | IGLELMSNEVK | 18.73 | 616.83 | 707.34 | 32 |
| 560 | IGLELMSNEVK | 18.73 | 616.83 | 820.42 | 32 |
| 561 | IGLELMSNEVK | 18.73 | 616.83 | 949.47 | 32 |
| 562 | IGLER | 10.96 | 294.18 | 304.16 | 18 |
| 563 | IGLER | 10.96 | 294.18 | 417.25 | 18 |
| 564 | IGLER | 10.96 | 294.18 | 474.27 | 18 |
| 565 | IGLNK | 9.59 | 272.68 | 374.24 | 17 |

TABLE 25-continued

| Transition number | Peptide | Retention time (minutes) | (m/z) filtered in Q1 | (m/z) filtered in Q3 | Collision energy (eV) |
|---|---|---|---|---|---|
| 566 | IGLNK | 9.59 | 272.68 | 398.24 | 17 |
| 567 | IGLNK | 9.59 | 272.68 | 431.26 | 17 |
| 568 | IGLNLMQK | 17.1 | 458.77 | 633.34 | 25 |
| 569 | IGLNLMQK | 17.09 | 458.77 | 746.42 | 25 |
| 570 | IGLNLMQK | 17.11 | 458.77 | 803.44 | 25 |
| 571 | IGPSLMQSELQR | 17.02 | 679.86 | 760.39 | 35 |
| 572 | IGPSLMQSELQR | 17.02 | 679.86 | 891.44 | 35 |
| 573 | IGPSLMQSELQR | 17.02 | 679.86 | 1188.6 | 35 |
| 574 | IGYGNMQIGTEVDQFWLK | 24.31 | 700.35 | 935.5 | 39 |
| 575 | IGYGNMQIGTEVDQFWLK | 24.32 | 1050.02 | 1164.54 | 51 |
| 576 | IGYGNMQIGTEVDQFWLK | 24.3 | 1050.02 | 1222.61 | 51 |
| 577 | IINHNLPVK | 11.88 | 349.88 | 456.32 | 21 |
| 578 | IINHNLPVK | 11.88 | 349.88 | 570.36 | 21 |
| 579 | IINHNLPVK | 11.88 | 349.88 | 592.32 | 21 |
| 580 | IINHNLPVR | 12.04 | 359.22 | 598.37 | 22 |
| 581 | IINHNLPVR | 12.04 | 538.32 | 598.37 | 29 |
| 582 | IINHNLPVR | 12.04 | 538.32 | 849.47 | 29 |
| 583 | ILFQQGTQQAC[CAM]AER | 14.51 | 550.61 | 606.27 | 32 |
| 584 | ILFQQGTQQAC[CAM]AER | 14.51 | 825.41 | 1020.45 | 41 |
| 585 | ILFQQGTQQAC[CAM]AER | 14.51 | 825.41 | 1148.51 | 41 |
| 586 | ILNNWFK | 18.98 | 467.76 | 594.3 | 26 |
| 587 | ILNNWFK | 18.98 | 467.76 | 708.35 | 26 |
| 588 | ILNNWFK | 18.97 | 467.76 | 821.43 | 26 |
| 589 | ILNTLISLEEK | 19.98 | 636.87 | 718.4 | 33 |
| 590 | ILNTLISLEEK | 19.98 | 636.87 | 1046.57 | 33 |
| 591 | ILNTLISLEEK | 19.98 | 636.87 | 1159.66 | 33 |
| 592 | INIVK | 11.43 | 293.7 | 359.27 | 18 |
| 593 | INIVK | 11.43 | 293.7 | 440.29 | 18 |
| 594 | INIVK | 11.43 | 293.7 | 473.31 | 18 |
| 595 | INLYGNALSR | 16.05 | 560.81 | 617.34 | 30 |
| 596 | INLYGNALSR | 16.05 | 560.81 | 780.4 | 30 |
| 597 | INLYGNALSR | 16.05 | 560.81 | 893.48 | 30 |
| 598 | IPFSLNLEMK | 21.68 | 596.33 | 834.44 | 31 |
| 599 | IPFSLNLEMK | 21.67 | 596.33 | 981.51 | 31 |
| 600 | IPFSLNLEMK | 21.67 | 596.33 | 1078.56 | 31 |
| 601 | IPHTLFALDADAVR | 20 | 513.62 | 531.29 | 30 |
| 602 | IPHTLFALDADAVR | 20 | 513.62 | 646.32 | 30 |
| 603 | IPHTLFALDADAVR | 20 | 769.92 | 1191.64 | 39 |

TABLE 25-continued

| Transition number | Peptide | Retention time (minutes) | (m/z) filtered in Q1 | (m/z) filtered in Q3 | Collision energy (eV) |
|---|---|---|---|---|---|
| 604 | IPHTLFALDAGAAR | 18.58 | 726.9 | 744.4 | 37 |
| 605 | IPHTLFALDAGAAR | 18.58 | 726.9 | 891.47 | 37 |
| 606 | IPHTLFALDAGAAR | 18.58 | 726.9 | 1004.55 | 37 |
| 607 | IPHTLFALDAGAVR | 19.72 | 494.28 | 588.31 | 29 |
| 608 | IPHTLFALDAGAVR | 19.71 | 494.28 | 780.44 | 29 |
| 609 | IPHTLFALDAGAVR | 19.72 | 740.92 | 1133.63 | 38 |
| 610 | IPNAIIGLETGVIK | 21.75 | 719.44 | 816.48 | 37 |
| 611 | IPNAIIGLETGVIK | 21.75 | 719.44 | 929.57 | 37 |
| 612 | IPNAIIGLETGVIK | 21.75 | 719.44 | 1227.73 | 37 |
| 613 | IPNALIGLETGAIK | 20.96 | 705.42 | 788.45 | 36 |
| 614 | IPNALIGLETGAIK | 20.96 | 705.42 | 901.54 | 36 |
| 615 | IPNALIGLETGAIK | 20.96 | 705.42 | 1014.62 | 36 |
| 616 | IPNSLIAFDTGAVR | 20.24 | 737.41 | 765.39 | 37 |
| 617 | IPNSLIAFDTGAVR | 20.24 | 737.41 | 836.43 | 37 |
| 618 | IPNSLIAFDTGAVR | 20.24 | 737.41 | 949.51 | 37 |
| 619 | IPSAIIGLETGVIK | 21.66 | 705.93 | 816.48 | 36 |
| 620 | IPSAIIGLETGVIK | 21.67 | 705.93 | 929.57 | 36 |
| 621 | IPSAIIGLETGVIK | 21.66 | 705.93 | 1200.72 | 36 |
| 622 | ISAFNQVK | 13.02 | 453.76 | 488.28 | 25 |
| 623 | ISAFNQVK | 13.02 | 453.76 | 706.39 | 25 |
| 624 | ISAFNQVK | 13.02 | 453.76 | 793.42 | 25 |
| 625 | ISAHEQILFLR | 18.28 | 442.92 | 548.36 | 26 |
| 626 | ISAHEQILFLR | 18.28 | 442.92 | 789.5 | 26 |
| 627 | ISAHEQILFLR | 18.28 | 663.88 | 918.54 | 34 |
| 628 | ISAMEQTR | 9.84 | 468.23 | 664.31 | 26 |
| 629 | ISAMEQTR | 9.84 | 468.23 | 735.35 | 26 |
| 630 | ISAMEQTR | 9.84 | 468.23 | 822.38 | 26 |
| 631 | ISAMEQVK | 11.65 | 453.24 | 634.32 | 25 |
| 632 | ISAMEQVK | 11.65 | 453.24 | 705.36 | 25 |
| 633 | ISAMEQVK | 11.65 | 453.24 | 792.39 | 25 |
| 634 | ISATEQVAFLR | 17.7 | 412.23 | 435.27 | 25 |
| 635 | ISATEQVAFLR | 17.71 | 412.23 | 506.31 | 25 |
| 636 | ISATEQVAFLR | 17.7 | 412.23 | 605.38 | 25 |
| 637 | ISATQQIAFLR | 18.58 | 624.36 | 747.45 | 32 |
| 638 | ISATQQIAFLR | 18.58 | 624.36 | 1047.59 | 32 |
| 639 | ISATQQIAFLR | 18.58 | 624.36 | 1134.63 | 32 |
| 640 | ISAVNQVEFLESLFLNK | 28.77 | 976.03 | 988.51 | 48 |
| 641 | ISAVNQVEFLESLFLNK | 28.77 | 976.03 | 1110.62 | 48 |

TABLE 25-continued

| Transition number | Peptide | Retention time (minutes) | (m/z) filtered in Q1 | (m/z) filtered in Q3 | Collision energy (eV) |
|---|---|---|---|---|---|
| 642 | ISAVNQVEFLESLFLNK | 28.77 | 976.03 | 1239.66 | 48 |
| 643 | ISAVNQVK | 10.32 | 429.76 | 488.28 | 24 |
| 644 | ISAVNQVK | 10.32 | 429.76 | 658.39 | 24 |
| 645 | ISAVNQVK | 10.32 | 429.76 | 745.42 | 24 |
| 646 | ISPEEQIQFLR | 18.87 | 680.37 | 933.52 | 35 |
| 647 | ISPEEQIQFLR | 18.87 | 680.37 | 1062.56 | 35 |
| 648 | ISPEEQIQFLR | 18.87 | 680.37 | 1159.61 | 35 |
| 649 | ISPEEQVR | 10.49 | 479.25 | 531.29 | 26 |
| 650 | ISPEEQVR | 10.49 | 479.25 | 660.33 | 26 |
| 651 | ISPEEQVR | 10.49 | 479.25 | 757.38 | 26 |
| 652 | ISPEGQVR | 9.86 | 443.24 | 459.27 | 25 |
| 653 | ISPEGQVR | 9.86 | 443.24 | 588.31 | 25 |
| 654 | ISPEGQVR | 9.86 | 443.24 | 685.36 | 25 |
| 655 | ISPLEQLAFLR | 24.02 | 643.88 | 876.49 | 33 |
| 656 | ISPLEQLAFLR | 24.01 | 643.88 | 989.58 | 33 |
| 657 | ISPLEQLAFLR | 24.02 | 643.88 | 1086.63 | 33 |
| 658 | ITAFQQVDFLR | 21.11 | 669.36 | 777.43 | 34 |
| 659 | ITAFQQVDFLR | 21.12 | 669.36 | 905.48 | 34 |
| 660 | ITAFQQVDFLR | 21.12 | 669.36 | 1123.59 | 34 |
| 661 | ITPIQEVNFADDFANNR | 21.25 | 655.32 | 736.34 | 37 |
| 662 | ITPIQEVNFADDFANNR | 21.25 | 655.32 | 851.36 | 37 |
| 663 | ITPIQEVNFADDFANNR | 21.25 | 655.32 | 922.4 | 37 |
| 664 | ITPIQEVNFADDLANNR | 20.95 | 643.99 | 817.38 | 36 |
| 665 | ITPIQEVNFADDLANNR | 20.95 | 965.49 | 1149.53 | 47 |
| 666 | ITPIQEVNFADDLANNR | 20.96 | 965.49 | 1248.6 | 47 |
| 667 | ITPQQEAQFAYK | 14.52 | 712.36 | 856.42 | 36 |
| 668 | ITPQQEAQFAYK | 14.52 | 712.36 | 984.48 | 36 |
| 669 | ITPQQEAQFAYK | 14.52 | 712.36 | 1209.59 | 36 |
| 670 | ITPQQEAQFTYK | 14.33 | 485.25 | 558.29 | 28 |
| 671 | ITPQQEAQFTYK | 14.33 | 727.37 | 1014.49 | 37 |
| 672 | ITPQQEAQFTYK | 14.33 | 727.37 | 1239.6 | 37 |
| 673 | ITPVQEVNFADDLAHNR | 18.98 | 646.99 | 840.4 | 36 |
| 674 | ITPVQEVNFADDLAHNR | 18.98 | 646.99 | 862.92 | 36 |
| 675 | ITPVQEVNFADDLAHNR | 18.98 | 646.99 | 911.43 | 36 |
| 676 | IVAFALK | 17.21 | 381.25 | 478.3 | 22 |
| 677 | IVAFALK | 17.22 | 381.25 | 549.34 | 22 |
| 678 | IVAFALK | 17.21 | 381.25 | 648.41 | 22 |
| 679 | IVAFALNMEMR | 17.95 | 647.84 | 864.41 | 34 |

TABLE 25-continued

| Transition number | Peptide | Retention time (minutes) | (m/z) filtered in Q1 | (m/z) filtered in Q3 | Collision energy (eV) |
|---|---|---|---|---|---|
| 680 | IVAFALNMEMR | 17.95 | 647.84 | 1011.48 | 34 |
| 681 | IVAFALNMEMR | 17.97 | 647.84 | 1082.51 | 34 |
| 682 | IVESTTLADGTWHGK | 13.69 | 542.96 | 697.4 | 31 |
| 683 | IVESTTLADGTWHGK | 13.69 | 542.96 | 812.43 | 31 |
| 684 | IVESTTLADGTWHGK | 13.68 | 542.96 | 883.46 | 31 |
| 685 | IYNSLIGLNEK | 17.37 | 632.35 | 673.39 | 33 |
| 686 | IYNSLIGLNEK | 17.37 | 632.35 | 786.47 | 33 |
| 687 | IYNSLIGLNEK | 17.37 | 632.35 | 987.55 | 33 |
| 688 | KPDIGWWVGWIER | 24.47 | 547.96 | 660.35 | 31 |
| 689 | KPDIGWWVGWIER | 24.47 | 547.96 | 883.45 | 31 |
| 690 | KPDIGWWVGWIER | 24.46 | 821.43 | 1188.59 | 41 |
| 691 | LAC[CAM]ATNNLAR | 11.22 | 552.28 | 688.37 | 29 |
| 692 | LAC[CAM]ATNNLAR | 11.22 | 552.28 | 759.41 | 29 |
| 693 | LAC[CAM]ATNNLAR | 11.22 | 552.28 | 919.44 | 29 |
| 694 | LAQGELPFPAPVQSTVR | 19.84 | 905.5 | 954.54 | 45 |
| 695 | LAQGELPFPAPVQSTVR | 19.84 | 905.5 | 1101.61 | 45 |
| 696 | LAQGELPFPAPVQSTVR | 19.84 | 905.5 | 1198.66 | 45 |
| 697 | LAQNELPYPIEIQK | 19.09 | 828.45 | 929.47 | 41 |
| 698 | LAQNELPYPIEIQK | 19.09 | 828.45 | 987.55 | 41 |
| 699 | LAQNELPYPIEIQK | 19.08 | 828.45 | 1100.64 | 41 |
| 700 | LAQNELQYPIEIQK | 17.98 | 843.96 | 890.5 | 42 |
| 701 | LAQNELQYPIEIQK | 17.98 | 843.96 | 1018.56 | 42 |
| 702 | LAQNELQYPIEIQK | 17.98 | 843.96 | 1131.64 | 42 |
| 703 | LDFGNK | 11.75 | 347.18 | 465.25 | 20 |
| 704 | LDFGNK | 11.74 | 347.18 | 547.25 | 20 |
| 705 | LDFGNK | 11.75 | 347.18 | 580.27 | 20 |
| 706 | LDGSLNR | 9.48 | 387.71 | 402.25 | 22 |
| 707 | LDGSLNR | 9.48 | 387.71 | 546.3 | 22 |
| 708 | LDGSLNR | 9.48 | 387.71 | 661.33 | 22 |
| 709 | LEILQQALAELGLYPK | 29.81 | 900.02 | 1003.58 | 45 |
| 710 | LEILQQALAELGLYPK | 29.81 | 900.02 | 1074.62 | 45 |
| 711 | LEILQQALAELGLYPK | 29.81 | 900.02 | 1202.68 | 45 |
| 712 | LENQEQVK | 7.6 | 494.26 | 631.34 | 27 |
| 713 | LENQEQVK | 7.59 | 494.26 | 745.38 | 27 |
| 714 | LENQEQVK | 7.59 | 494.26 | 874.43 | 27 |
| 715 | LETQEEVEK | 9.88 | 552.77 | 633.31 | 29 |
| 716 | LETQEEVEK | 9.88 | 552.77 | 862.42 | 29 |
| 717 | LETQEEVEK | 9.88 | 552.77 | 991.46 | 29 |

TABLE 25-continued

| Transition number | Peptide | Retention time (minutes) | (m/z) filtered in Q1 | (m/z) filtered in Q3 | Collision energy (eV) |
|---|---|---|---|---|---|
| 718 | LETQEEVK | 9.5 | 488.25 | 504.27 | 26 |
| 719 | LETQEEVK | 9.49 | 488.25 | 733.37 | 26 |
| 720 | LETQEEVK | 9.49 | 488.25 | 862.42 | 26 |
| 721 | LFAAEGVK | 13.53 | 417.74 | 503.28 | 23 |
| 722 | LFAAEGVK | 13.53 | 417.74 | 574.32 | 23 |
| 723 | LFAAEGVK | 13.53 | 417.74 | 721.39 | 23 |
| 724 | LFESAGVK | 12.99 | 425.74 | 461.27 | 24 |
| 725 | LFESAGVK | 12.99 | 425.74 | 590.31 | 24 |
| 726 | LFESAGVK | 12.99 | 425.74 | 737.38 | 24 |
| 727 | LFGAAGVK | 13.94 | 381.73 | 445.28 | 22 |
| 728 | LFGAAGVK | 13.94 | 381.73 | 502.3 | 22 |
| 729 | LFGAAGVK | 13.94 | 381.73 | 649.37 | 22 |
| 730 | LGVDR | 8.51 | 280.16 | 290.15 | 17 |
| 731 | LGVDR | 8.51 | 280.16 | 389.21 | 17 |
| 732 | LGVDR | 8.5 | 280.16 | 446.24 | 17 |
| 733 | LLNLLSQSK | 17.97 | 508.31 | 562.32 | 27 |
| 734 | LLNLLSQSK | 17.97 | 508.31 | 789.45 | 27 |
| 735 | LLNLLSQSK | 17.97 | 508.31 | 902.53 | 27 |
| 736 | LLQDER | 9.34 | 387.21 | 547.25 | 22 |
| 737 | LLQDER | 9.31 | 387.21 | 599.3 | 22 |
| 738 | LLQDER | 9.34 | 387.21 | 660.33 | 22 |
| 739 | LLVQDGDC[CAM]GR | 11.92 | 566.77 | 679.25 | 30 |
| 740 | LLVQDGDC[CAM]GR | 11.92 | 566.77 | 807.3 | 30 |
| 741 | LLVQDGDC[CAM]GR | 11.92 | 566.77 | 906.37 | 30 |
| 742 | LNEVGYGNR | 10.74 | 511.26 | 566.27 | 27 |
| 743 | LNEVGYGNR | 10.74 | 511.26 | 665.34 | 27 |
| 744 | LNEVGYGNR | 10.73 | 511.26 | 794.38 | 27 |
| 745 | LNYGNADPSTK | 10.76 | 590.29 | 732.35 | 31 |
| 746 | LNYGNADPSTK | 10.76 | 590.29 | 789.37 | 31 |
| 747 | LNYGNADPSTK | 10.76 | 590.29 | 952.44 | 31 |
| 748 | LNYGNK | 7.21 | 354.69 | 481.24 | 21 |
| 749 | LNYGNK | 7.24 | 354.69 | 562.26 | 21 |
| 750 | LNYGNK | 7.22 | 354.69 | 595.28 | 21 |
| 751 | LPASK | 1.93 | 258.16 | 305.18 | 16 |
| 752 | LPASK | 1.93 | 258.16 | 369.21 | 16 |
| 753 | LPASK | 1.93 | 258.16 | 402.23 | 16 |
| 754 | LPHTLFALDADAVR | 19.98 | 769.92 | 977.51 | 39 |
| 755 | LPHTLFALDADAVR | 19.98 | 769.92 | 1090.59 | 39 |

TABLE 25-continued

| Transition number | Peptide | Retention time (minutes) | (m/z) filtered in Q1 | (m/z) filtered in Q3 | Collision energy (eV) |
|---|---|---|---|---|---|
| 756 | LPHTLFALDADAVR | 19.98 | 769.92 | 1191.64 | 39 |
| 757 | LPHTLFALDAGAVR | 19.7 | 740.92 | 919.5 | 38 |
| 758 | LPHTLFALDAGAVR | 19.67 | 740.92 | 1032.58 | 38 |
| 759 | LPHTLFALDAGAVR | 19.7 | 740.92 | 1133.63 | 38 |
| 760 | LPLAIMGFDSGILQSPK | 25.08 | 893.99 | 944.5 | 44 |
| 761 | LPLAIMGFDSGILQSPK | 25.08 | 893.99 | 1091.57 | 44 |
| 762 | LPLAIMGFDSGILQSPK | 25.08 | 893.99 | 1148.59 | 44 |
| 763 | LPLAIMGYDADILLDATTPR | 27.86 | 720.39 | 773.42 | 40 |
| 764 | LPLAIMGYDADILLDATTPR | 27.87 | 720.39 | 886.5 | 40 |
| 765 | LPLAIMGYDADILLDATTPR | 27.87 | 720.39 | 1160.57 | 40 |
| 766 | LPSSLIALETGAVR | 20.6 | 713.92 | 816.46 | 36 |
| 767 | LPSSLIALETGAVR | 20.6 | 713.92 | 929.54 | 36 |
| 768 | LPSSLIALETGAVR | 20.6 | 713.92 | 1216.69 | 36 |
| 769 | LPVSAQTLQYTANILK | 21.84 | 880.5 | 950.53 | 44 |
| 770 | LPVSAQTLQYTANILK | 21.84 | 880.5 | 1063.61 | 44 |
| 771 | LPVSAQTLQYTANILK | 21.85 | 880.5 | 1164.66 | 44 |
| 772 | LPVSER | 9.57 | 350.7 | 490.26 | 20 |
| 773 | LPVSER | 9.57 | 350.7 | 526.29 | 20 |
| 774 | LPVSER | 9.57 | 350.7 | 587.31 | 20 |
| 775 | LPVSPTAVDMTER | 16.21 | 708.36 | 1019.48 | 36 |
| 776 | LPVSPTAVDMTER | 16.21 | 708.36 | 1106.51 | 36 |
| 777 | LPVSPTAVDMTER | 16.21 | 708.36 | 1205.58 | 36 |
| 778 | LSASK | 10.72 | 253.15 | 305.18 | 16 |
| 779 | LSASK | 10.71 | 253.15 | 359.19 | 16 |
| 780 | LSASK | 10.71 | 253.15 | 392.21 | 16 |
| 781 | LSAVPIYQEVAR | 17.96 | 673.38 | 765.39 | 35 |
| 782 | LSAVPIYQEVAR | 17.96 | 673.38 | 975.53 | 35 |
| 783 | LSAVPIYQEVAR | 17.95 | 673.38 | 1074.59 | 35 |
| 784 | LSAVPVYQELAR | 18.45 | 449.25 | 616.34 | 26 |
| 785 | LSAVPVYQELAR | 18.44 | 673.38 | 779.4 | 35 |
| 786 | LSAVPVYQELAR | 18.44 | 673.38 | 975.53 | 35 |
| 787 | LSC[CAM]TLVIDEASGDLLHR | 20.38 | 633.66 | 797.43 | 36 |
| 788 | LSC[CAM]TLVIDEASGDLLHR | 20.38 | 633.66 | 868.46 | 36 |
| 789 | LSC[CAM]TLVIDEASGDLLHR | 20.38 | 633.66 | 1112.53 | 36 |
| 790 | LSLQHGWFIGWIEK | 23.95 | 571.98 | 632.34 | 33 |
| 791 | LSLQHGWFIGWIEK | 23.95 | 571.98 | 892.49 | 33 |
| 792 | LSLQHGWFIGWIEK | 23.95 | 571.98 | 969.49 | 33 |
| 793 | LSQNSLPFSQEAMNSVK | 18.64 | 627.31 | 1140.54 | 35 |

TABLE 25-continued

| Transition number | Peptide | Retention time (minutes) | (m/z) filtered in Q1 | (m/z) filtered in Q3 | Collision energy (eV) |
|---|---|---|---|---|---|
| 794 | LSQNSLPFSQEAMNSVK | 18.63 | 940.46 | 1140.54 | 46 |
| 795 | LSQNSLPFSQEAMNSVK | 18.64 | 940.46 | 1237.59 | 46 |
| 796 | LSVNPK | 9.8 | 329.2 | 457.28 | 19 |
| 797 | LSVNPK | 9.79 | 329.2 | 511.29 | 19 |
| 798 | LSVNPK | 9.8 | 329.2 | 544.31 | 19 |
| 799 | LTVGAR | 9.51 | 308.69 | 402.25 | 19 |
| 800 | LTVGAR | 9.51 | 308.69 | 442.27 | 19 |
| 801 | LTVGAR | 9.51 | 308.69 | 503.29 | 19 |
| 802 | LYGFALNIDMPGGEADIGK | 23.35 | 661 | 843.42 | 37 |
| 803 | LYGFALNIDMPGGEADIGK | 23.35 | 990.99 | 1089.49 | 49 |
| 804 | LYGFALNIDMPGGEADIGK | 23.35 | 990.99 | 1202.57 | 49 |
| 805 | LYHNELPFR | 15.29 | 396.88 | 414.21 | 24 |
| 806 | LYHNELPFR | 15.29 | 396.88 | 419.24 | 24 |
| 807 | LYHNELPFR | 15.29 | 396.88 | 657.3 | 24 |
| 808 | LYHNK | 8.54 | 337.68 | 414.21 | 20 |
| 809 | LYHNK | 8.53 | 337.68 | 528.26 | 20 |
| 810 | LYHNK | 8.53 | 337.68 | 561.28 | 20 |
| 811 | LYQNDLPFR | 17.2 | 583.3 | 761.39 | 31 |
| 812 | LYQNDLPFR | 17.2 | 583.3 | 889.45 | 31 |
| 813 | LYQNDLPFR | 17.2 | 583.3 | 1052.52 | 31 |
| 814 | MDDLFK | 15.5 | 384.68 | 522.29 | 22 |
| 815 | MDDLFK | 15.5 | 384.68 | 622.25 | 22 |
| 816 | MDDLFK | 15.5 | 384.68 | 637.32 | 22 |
| 817 | MEDLHK | 6.66 | 386.69 | 512.28 | 22 |
| 818 | MEDLHK | 6.65 | 386.69 | 626.26 | 22 |
| 819 | MEDLHK | 6.66 | 386.69 | 641.33 | 22 |
| 820 | MLIALIGLENHK | 21.33 | 451.26 | 527.26 | 27 |
| 821 | MLIALIGLENHK | 21.33 | 451.26 | 697.36 | 27 |
| 822 | MLIALIGLENHK | 21.33 | 451.26 | 810.45 | 27 |
| 823 | MLLIK | 15.81 | 309.21 | 373.28 | 19 |
| 824 | MLLIK | 15.81 | 309.21 | 471.3 | 19 |
| 825 | MLLIK | 15.81 | 309.21 | 486.36 | 19 |
| 826 | MLNALIGLEHHK | 16.89 | 459.26 | 550.27 | 27 |
| 827 | MLNALIGLEHHK | 16.89 | 459.26 | 720.38 | 27 |
| 828 | MLNALIGLEHHK | 16.89 | 459.26 | 833.46 | 27 |
| 829 | MLNALIGLENHK | 18.39 | 451.58 | 697.36 | 27 |
| 830 | MLNALIGLENHK | 18.38 | 676.87 | 697.36 | 35 |
| 831 | MLNALIGLENHK | 18.39 | 676.87 | 810.45 | 35 |

TABLE 25-continued

| Transition number | Peptide | Retention time (minutes) | (m/z) filtered in Q1 | (m/z) filtered in Q3 | Collision energy (eV) |
|---|---|---|---|---|---|
| 832 | MLNALIGLENQK | 19.71 | 672.37 | 688.36 | 35 |
| 833 | MLNALIGLENQK | 19.71 | 672.37 | 801.45 | 35 |
| 834 | MLNALIGLENQK | 19.71 | 672.37 | 914.53 | 35 |
| 835 | MLNALIGLEYHK | 19.6 | 701.38 | 746.38 | 36 |
| 836 | MLNALIGLEYHK | 19.6 | 701.38 | 859.47 | 36 |
| 837 | MLNALIGLEYHK | 19.6 | 701.38 | 1157.63 | 36 |
| 838 | MLNALIGLQHGK | 17.5 | 432.25 | 582.34 | 26 |
| 839 | MLNALIGLQHGK | 17.5 | 432.25 | 639.36 | 26 |
| 840 | MLNALIGLQHGK | 17.5 | 432.25 | 752.44 | 26 |
| 841 | MLNALISLEHHK | 17.2 | 352.23 | 59.17 | 21 |
| 842 | MLNALISLEHHK | 17.21 | 469.26 | 750.39 | 27 |
| 843 | MLNALISLEHHK | 17.2 | 469.26 | 863.47 | 27 |
| 844 | MQAYVDAFDYGNR | 17.56 | 775.34 | 957.41 | 39 |
| 845 | MQAYVDAFDYGNR | 17.56 | 775.34 | 1056.47 | 39 |
| 846 | MQAYVDAFDYGNR | 17.56 | 775.34 | 1219.54 | 39 |
| 847 | MQEGLNK | 8.68 | 410.21 | 560.3 | 23 |
| 848 | MQEGLNK | 8.66 | 410.21 | 673.3 | 23 |
| 849 | MQEGLNK | 8.68 | 410.21 | 688.36 | 23 |
| 850 | MSPASTYK | 9.49 | 442.71 | 569.29 | 24 |
| 851 | MSPASTYK | 9.49 | 442.71 | 666.35 | 24 |
| 852 | MSPASTYK | 9.49 | 442.71 | 753.38 | 24 |
| 853 | NEHDPVLPYR | 13.09 | 413.88 | 435.24 | 25 |
| 854 | NEHDPVLPYR | 13.09 | 620.31 | 744.44 | 32 |
| 855 | NEHDPVLPYR | 13.09 | 620.31 | 859.47 | 32 |
| 856 | NEHQIFK | 9.91 | 458.24 | 509.21 | 25 |
| 857 | NEHQIFK | 9.91 | 458.24 | 622.29 | 25 |
| 858 | NEHQIFK | 9.91 | 458.24 | 672.38 | 25 |
| 859 | NEHQVFK | 7.74 | 451.23 | 658.37 | 25 |
| 860 | NEHQVFK | 7.74 | 451.23 | 755.35 | 25 |
| 861 | NEHQVFK | 7.74 | 451.23 | 787.41 | 25 |
| 862 | NEITYK | 9.35 | 384.25 | 24.31 | 22 |
| 863 | NEITYK | 9.35 | 384.26 | 21.29 | 22 |
| 864 | NEITYK | 9.35 | 384.26 | 53.35 | 22 |
| 865 | NELLMK | 13.08 | 374.21 | 504.32 | 21 |
| 866 | NELLMK | 13.09 | 374.21 | 601.3 | 21 |
| 867 | NELLMK | 13.09 | 374.21 | 633.36 | 21 |
| 868 | NELPFR | 14.39 | 388.21 | 419.24 | 22 |
| 869 | NELPFR | 14.39 | 388.21 | 532.32 | 22 |

TABLE 25-continued

| Transition number | Peptide | Retention time (minutes) | (m/z) filtered in Q1 | (m/z) filtered in Q3 | Collision energy (eV) |
|---|---|---|---|---|---|
| 870 | NELPFR | 14.4 | 388.21 | 661.37 | 22 |
| 871 | NISSYGNNLVR | 14.36 | 618.82 | 835.44 | 32 |
| 872 | NISSYGNNLVR | 14.36 | 618.82 | 922.47 | 32 |
| 873 | NISSYGNNLVR | 14.36 | 618.82 | 1009.51 | 32 |
| 874 | NISTYGNNLTR | 13.1 | 626.82 | 674.36 | 33 |
| 875 | NISTYGNNLTR | 13.09 | 626.82 | 837.42 | 33 |
| 876 | NISTYGNNLTR | 13.1 | 626.82 | 1025.5 | 33 |
| 877 | NLFNEVHTTGVLVIR | 20.69 | 571.32 | 757.49 | 33 |
| 878 | NLFNEVHTTGVLVIR | 20.7 | 571.32 | 858.54 | 33 |
| 879 | NLFNEVHTTGVLVIR | 20.7 | 571.32 | 995.6 | 33 |
| 880 | NLSTYGNALAR | 14.34 | 590.31 | 764.4 | 31 |
| 881 | NLSTYGNALAR | 14.35 | 590.31 | 865.45 | 31 |
| 882 | NLSTYGNALAR | 14.35 | 590.31 | 952.48 | 31 |
| 883 | NMENLELFGK | 19.08 | 597.79 | 820.46 | 31 |
| 884 | NMENLELFGK | 19.08 | 597.79 | 949.5 | 31 |
| 885 | NMENLELFGK | 19.08 | 597.79 | 1080.54 | 31 |
| 886 | NMLLLEENNGYK | 16.71 | 719.36 | 853.37 | 37 |
| 887 | NMLLLEENNGYK | 16.69 | 719.36 | 966.45 | 37 |
| 888 | NMLLLEENNGYK | 16.68 | 719.36 | 1079.54 | 37 |
| 889 | NMLLLEESNGYK | 18.12 | 705.85 | 939.44 | 36 |
| 890 | NMLLLEESNGYK | 18.13 | 705.85 | 1052.53 | 36 |
| 891 | NMLLLEESNGYK | 18.11 | 705.85 | 1165.61 | 36 |
| 892 | NMLLLEK | 16.99 | 430.75 | 502.32 | 24 |
| 893 | NMLLLEK | 16.98 | 430.75 | 615.41 | 24 |
| 894 | NMLLLEK | 16.98 | 430.75 | 746.45 | 24 |
| 895 | NMTLGDAMK | 14.42 | 490.73 | 521.24 | 27 |
| 896 | NMTLGDAMK | 14.42 | 490.73 | 634.32 | 27 |
| 897 | NMTLGDAMK | 14.42 | 490.73 | 735.37 | 27 |
| 898 | NNGLTEAWLESSLK | 20.61 | 781.4 | 862.47 | 39 |
| 899 | NNGLTEAWLESSLK | 20.6 | 781.4 | 933.5 | 39 |
| 900 | NNGLTEAWLESSLK | 20.62 | 781.41 | 163.59 | 39 |
| 901 | NQLPFK | 13.49 | 373.71 | 391.23 | 21 |
| 902 | NQLPFK | 13.49 | 373.71 | 504.32 | 21 |
| 903 | NQLPFK | 13.49 | 373.71 | 632.38 | 21 |
| 904 | NQLPFQVEHQR | 14.33 | 698.36 | 796.41 | 36 |
| 905 | NQLPFQVEHQR | 14.33 | 698.36 | 1040.53 | 36 |
| 906 | NQLPFQVEHQR | 14.33 | 698.36 | 1153.61 | 36 |
| 907 | NSAIENTIDNMYLQDLENSTK | 22.77 | 805.04 | 934.45 | 44 |

TABLE 25-continued

| Transition number | Peptide | Retention time (minutes) | (m/z) filtered in Q1 | (m/z) filtered in Q3 | Collision energy (eV) |
|---|---|---|---|---|---|
| 908 | NSAIENTIDNMYLQDLENSTK | 22.77 | 805.04 | 1047.53 | 44 |
| 909 | NSAIENTIDNMYLQDLENSTK | 22.77 | 805.04 | 1210.6 | 44 |
| 910 | NSAIENTIENMYLQDLDNSTK | 23.13 | 805.04 | 920.43 | 44 |
| 911 | NSAIENTIENMYLQDLDNSTK | 23.13 | 805.04 | 1033.52 | 44 |
| 912 | NSAIENTIENMYLQDLDNSTK | 23.14 | 805.04 | 1196.58 | 44 |
| 913 | NSAIENTIENMYLQDLENSTK | 23.7 | 809.72 | 934.45 | 44 |
| 914 | NSAIENTIENMYLQDLENSTK | 23.7 | 809.72 | 1047.53 | 44 |
| 915 | NSAIENTIENMYLQDLENSTK | 23.7 | 809.72 | 1217.55 | 44 |
| 916 | NSAVWVYELFAK | 24.66 | 713.87 | 869.48 | 36 |
| 917 | NSAVWVYELFAK | 24.66 | 713.87 | 1055.56 | 36 |
| 918 | NSAVWVYELFAK | 24.65 | 713.87 | 1154.62 | 36 |
| 919 | NSQVPAYK | 9.78 | 453.74 | 478.27 | 25 |
| 920 | NSQVPAYK | 9.78 | 453.74 | 577.33 | 25 |
| 921 | NSQVPAYK | 9.78 | 453.74 | 705.39 | 25 |
| 922 | NSTVWIYELFAK | 25.64 | 735.88 | 883.49 | 37 |
| 923 | NSTVWIYELFAK | 25.64 | 735.88 | 1069.57 | 37 |
| 924 | NSTVWIYELFAK | 25.64 | 735.88 | 1168.64 | 37 |
| 925 | NSTVWVYELFAK | 24.42 | 728.88 | 770.41 | 37 |
| 926 | NSTVWVYELFAK | 24.43 | 728.88 | 869.48 | 37 |
| 927 | NSTVWVYELFAK | 24.42 | 728.88 | 1055.56 | 37 |
| 928 | NSTVWVYQLFAK | 23.9 | 728.39 | 769.42 | 37 |
| 929 | NSTVWVYQLFAK | 23.91 | 728.39 | 1054.57 | 37 |
| 930 | NSTVWVYQLFAK | 23.91 | 728.39 | 1153.64 | 37 |
| 931 | NTSGALVIQTDK | 13.34 | 623.84 | 816.48 | 32 |
| 932 | NTSGALVIQTDK | 13.34 | 623.84 | 944.54 | 32 |
| 933 | NTSGALVIQTDK | 13.34 | 623.84 | 1031.57 | 32 |
| 934 | NTSGVLVIQTDK | 14.9 | 637.85 | 816.48 | 33 |
| 935 | NTSGVLVIQTDK | 14.9 | 637.85 | 972.57 | 33 |
| 936 | NTSGVLVIQTDK | 14.91 | 637.85 | 1059.6 | 33 |
| 937 | NVDEMFYYYDGSK | 18.86 | 815.84 | 895.38 | 41 |
| 938 | NVDEMFYYYDGSK | 18.86 | 815.84 | 1042.45 | 41 |
| 939 | NVDEMFYYYDGSK | 18.85 | 815.84 | 1173.49 | 41 |
| 940 | NWILR | 16.3 | 351.21 | 414.21 | 20 |
| 941 | NWILR | 16.29 | 351.21 | 527.3 | 20 |
| 942 | NWILR | 16.3 | 351.21 | 587.37 | 20 |
| 943 | NWNAAMDLR | 16.54 | 545.76 | 605.31 | 29 |
| 944 | NWNAAMDLR | 16.55 | 545.76 | 676.34 | 29 |
| 945 | NWNAAMDLR | 16.54 | 545.76 | 790.39 | 29 |

TABLE 25-continued

| Transition number | Peptide | Retention time (minutes) | (m/z) filtered in Q1 | (m/z) filtered in Q3 | Collision energy (eV) |
|---|---|---|---|---|---|
| 946 | NYVDAFHYGNQDISGDK | 15.76 | 648.29 | 933.43 | 36 |
| 947 | NYVDAFHYGNQDISGDK | 15.77 | 648.29 | 1096.49 | 36 |
| 948 | NYVDAFHYGNQDISGDK | 15.76 | 971.93 | 1233.55 | 48 |
| 949 | QADHAILVFDQAR | 16.58 | 495.26 | 523.23 | 29 |
| 950 | QADHAILVFDQAR | 16.61 | 495.26 | 636.31 | 29 |
| 951 | QADHAILVFDQAR | 16.58 | 495.26 | 735.38 | 29 |
| 952 | QAEHALLVFGQER | 16.86 | 499.93 | 636.31 | 29 |
| 953 | QAEHALLVFGQER | 16.85 | 499.93 | 735.38 | 29 |
| 954 | QAEHALLVFGQER | 16.87 | 499.93 | 763.41 | 29 |
| 955 | QAITK | 11 | 280.67 | 361.24 | 17 |
| 956 | QAITK | 11 | 280.67 | 414.23 | 17 |
| 957 | QAITK | 11.01 | 280.67 | 432.28 | 17 |
| 958 | QAMLTEANSDYIIR | 18.26 | 812.9 | 951.49 | 41 |
| 959 | QAMLTEANSDYIIR | 18.25 | 812.9 | 1080.53 | 41 |
| 960 | QAMLTEANSDYIIR | 18.26 | 812.9 | 1181.58 | 41 |
| 961 | QEVQFVSALAR | 17.69 | 624.34 | 763.45 | 32 |
| 962 | QEVQFVSALAR | 17.68 | 624.34 | 891.5 | 32 |
| 963 | QEVQFVSALAR | 17.68 | 624.34 | 990.57 | 32 |
| 964 | QFASIK | 11.66 | 347.2 | 434.2 | 20 |
| 965 | QFASIK | 11.66 | 347.2 | 547.29 | 20 |
| 966 | QFASIK | 11.68 | 347.2 | 565.33 | 20 |
| 967 | QGMPGSIR | 11.4 | 423.22 | 529.31 | 24 |
| 968 | QGMPGSIR | 11.43 | 423.22 | 660.35 | 24 |
| 969 | QGMPGSIR | 11.4 | 423.22 | 717.37 | 24 |
| 970 | QGMSGSIR | 9.44 | 418.21 | 519.29 | 23 |
| 971 | QGMSGSIR | 9.45 | 418.21 | 650.33 | 23 |
| 972 | QGMSGSIR | 9.44 | 418.21 | 707.35 | 23 |
| 973 | QGQTQQSYGNDLAR | 11.16 | 783.37 | 895.43 | 39 |
| 974 | QGQTQQSYGNDLAR | 11.17 | 783.37 | 1023.49 | 39 |
| 975 | QGQTQQSYGNDLAR | 11.16 | 783.37 | 1151.54 | 39 |
| 976 | QIDYGNADPSTIK | 13.41 | 711.35 | 845.44 | 36 |
| 977 | QIDYGNADPSTIK | 13.42 | 711.35 | 902.46 | 36 |
| 978 | QIDYGNADPSTIK | 13.42 | 711.35 | 1065.52 | 36 |
| 979 | QIDYGNVDPSTIK | 15.08 | 725.36 | 873.47 | 37 |
| 980 | QIDYGNVDPSTIK | 15.07 | 725.36 | 930.49 | 37 |
| 981 | QIDYGNVDPSTIK | 15.07 | 725.36 | 1093.55 | 37 |
| 982 | QIGQAR | 2.3 | 336.69 | 431.24 | 20 |
| 983 | QIGQAR | 2.33 | 336.69 | 498.27 | 20 |

TABLE 25-continued

| Transition number | Peptide | Retention time (minutes) | (m/z) filtered in Q1 | (m/z) filtered in Q3 | Collision energy (eV) |
|---|---|---|---|---|---|
| 984 | QIGQAR | 2.32 | 336.69 | 544.32 | 20 |
| 985 | QIMLIEQTPAFTLR | 24.42 | 830.96 | 933.52 | 42 |
| 986 | QIMLIEQTPAFTLR | 24.42 | 830.96 | 1062.56 | 42 |
| 987 | QIMLIEQTPAFTLR | 24.42 | 830.96 | 1175.64 | 42 |
| 988 | QLGSAIDQFWLR | 22.67 | 717.38 | 864.44 | 37 |
| 989 | QLGSAIDQFWLR | 22.68 | 717.38 | 977.52 | 37 |
| 990 | QLGSAIDQFWLR | 22.67 | 717.38 | 1192.61 | 37 |
| 991 | QLPVK | 9.57 | 292.69 | 343.23 | 18 |
| 992 | QLPVK | 9.58 | 292.69 | 438.27 | 18 |
| 993 | QLPVK | 9.57 | 292.69 | 456.32 | 18 |
| 994 | QLSLDVLDK | 18.63 | 515.79 | 589.32 | 28 |
| 995 | QLSLDVLDK | 18.62 | 515.79 | 789.44 | 28 |
| 996 | QLSLDVLDK | 18.63 | 515.79 | 902.52 | 28 |
| 997 | QLVYAR | 11.04 | 375.22 | 508.29 | 22 |
| 998 | QLVYAR | 11.04 | 375.22 | 575.32 | 22 |
| 999 | QLVYAR | 11.04 | 375.22 | 621.37 | 22 |
| 1000 | QMMLTEASTDYIIR | 19.82 | 836.41 | 867.46 | 42 |
| 1001 | QMMLTEASTDYIIR | 19.82 | 836.41 | 1067.54 | 42 |
| 1002 | QMMLTEASTDYIIR | 19.82 | 836.41 | 1168.58 | 42 |
| 1003 | QMSIVEATPDYVLHGK | 18.77 | 894.45 | 1029.54 | 44 |
| 1004 | QMSIVEATPDYVLHGK | 18.77 | 894.45 | 1100.57 | 44 |
| 1005 | QMSIVEATPDYVLHGK | 18.77 | 894.45 | 1229.62 | 44 |
| 1006 | QTLVFAR | 14.65 | 417.75 | 492.29 | 23 |
| 1007 | QTLVFAR | 14.65 | 417.75 | 605.38 | 23 |
| 1008 | QTLVFAR | 14.65 | 417.75 | 706.42 | 23 |
| 1009 | QVVFAR | 12.06 | 360.21 | 492.29 | 21 |
| 1010 | QVVFAR | 12.04 | 360.21 | 545.31 | 21 |
| 1011 | QVVFAR | 12.06 | 360.21 | 591.36 | 21 |
| 1012 | SADEVLPYGGKPQR | 12.96 | 506.26 | 642.37 | 29 |
| 1013 | SADEVLPYGGKPQR | 12.96 | 506.26 | 805.43 | 29 |
| 1014 | SADEVLPYGGKPQR | 12.96 | 506.26 | 902.48 | 29 |
| 1015 | SC[CAM]ATNDLAR | 9.37 | 504.23 | 689.36 | 27 |
| 1016 | SC[CAM]ATNDLAR | 9.37 | 504.23 | 760.39 | 27 |
| 1017 | SC[CAM]ATNDLAR | 9.37 | 504.23 | 920.43 | 27 |
| 1018 | SC[CAM]ATNNLAR | 8.66 | 503.74 | 688.37 | 27 |
| 1019 | SC[CAM]ATNNLAR | 8.66 | 503.74 | 759.41 | 27 |
| 1020 | SC[CAM]ATNNLAR | 8.67 | 503.74 | 919.44 | 27 |
| 1021 | SDIPGGSK | 7.63 | 380.75 | 58.32 | 22 |

TABLE 25-continued

| Transition number | Peptide | Retention time (minutes) | (m/z) filtered in Q1 | (m/z) filtered in Q3 | Collision energy (eV) |
|---|---|---|---|---|---|
| 1022 | SDIPGGSK | 7.63 | 380.76 | 14.28 | 22 |
| 1023 | SDIPGGSK | 7.63 | 380.76 | 73.35 | 22 |
| 1024 | SDWGK | 5.75 | 296.64 | 390.21 | 18 |
| 1025 | SDWGK | 5.75 | 296.64 | 446.17 | 18 |
| 1026 | SDWGK | 5.75 | 296.64 | 505.24 | 18 |
| 1027 | SEDNFHISSQQHEK | 10.36 | 422.19 | 541.27 | 24 |
| 1028 | SEDNFHISSQQHEK | 10.36 | 422.19 | 730.28 | 24 |
| 1029 | SEDNFHISSQQHEK | 10.36 | 422.19 | 756.36 | 24 |
| 1030 | SEMPASIR | 12.02 | 445.72 | 674.37 | 25 |
| 1031 | SEMPASIR | 12.02 | 445.72 | 716.33 | 25 |
| 1032 | SEMPASIR | 12.02 | 445.72 | 803.41 | 25 |
| 1033 | SEMPASTR | 8.2 | 439.71 | 662.33 | 24 |
| 1034 | SEMPASTR | 8.19 | 439.71 | 704.29 | 24 |
| 1035 | SEMPASTR | 8.19 | 439.71 | 791.37 | 24 |
| 1036 | SFAAHNQDQDLR | 10.35 | 467.89 | 531.29 | 27 |
| 1037 | SFAAHNQDQDLR | 10.35 | 467.89 | 871.37 | 27 |
| 1038 | SFAAHNQDQDLR | 10.35 | 467.89 | 888.42 | 27 |
| 1039 | SFAGHNK | 9.4 | 380.69 | 455.24 | 22 |
| 1040 | SFAGHNK | 9.4 | 380.69 | 526.27 | 22 |
| 1041 | SFAGHNK | 9.38 | 380.69 | 673.34 | 22 |
| 1042 | SFAGHNQDQDLR | 10.18 | 694.32 | 888.42 | 36 |
| 1043 | SFAGHNQDQDLR | 10.18 | 694.32 | 1025.48 | 36 |
| 1044 | SFAGHNQDQDLR | 10.18 | 694.32 | 1082.5 | 36 |
| 1045 | SFAGHNQDQNLR | 9.8 | 462.89 | 530.3 | 27 |
| 1046 | SFAGHNQDQNLR | 9.8 | 462.89 | 773.39 | 27 |
| 1047 | SFAGHNQDQNLR | 9.8 | 462.89 | 887.43 | 27 |
| 1048 | SFLESWAK | 18.27 | 484.25 | 491.26 | 26 |
| 1049 | SFLESWAK | 18.27 | 484.25 | 620.3 | 26 |
| 1050 | SFLESWAK | 18.27 | 484.25 | 733.39 | 26 |
| 1051 | SFTAWEK | 14.44 | 434.71 | 462.23 | 24 |
| 1052 | SFTAWEK | 14.44 | 434.71 | 533.27 | 24 |
| 1053 | SFTAWEK | 14.44 | 434.71 | 634.32 | 24 |
| 1054 | SFTTWEK | 14.1 | 449.72 | 462.23 | 25 |
| 1055 | SFTTWEK | 14.1 | 449.72 | 563.28 | 25 |
| 1056 | SFTTWEK | 14.1 | 449.72 | 664.33 | 25 |
| 1057 | SGSGWLR | 13.25 | 381.7 | 531.3 | 22 |
| 1058 | SGSGWLR | 13.25 | 381.7 | 618.34 | 22 |
| 1059 | SGSGWLR | 13.25 | 381.7 | 675.36 | 22 |

TABLE 25-continued

| Transition number | Peptide | Retention time (minutes) | (m/z) filtered in Q1 | (m/z) filtered in Q3 | Collision energy (eV) |
|---|---|---|---|---|---|
| 1060 | SGWGMAVDPQVGWYVGFVEK | 24.65 | 738.02 | 841.45 | 41 |
| 1061 | SGWGMAVDPQVGWYVGFVEK | 24.65 | 738.02 | 1029.45 | 41 |
| 1062 | SGWGMAVDPQVGWYVGFVEK | 24.68 | 1106.53 | 1128.51 | 54 |
| 1063 | SGWGMDVSPQVGWLTGWVEK | 26.32 | 1110.03 | 1144.51 | 54 |
| 1064 | SGWGMDVSPQVGWLTGWVEK | 26.32 | 1110.03 | 1174.63 | 54 |
| 1065 | SGWGMDVSPQVGWLTGWVEK | 26.32 | 1110.03 | 1201.53 | 54 |
| 1066 | SGWGMDVTPQVGWLTGWVEK | 26.61 | 745.03 | 832.46 | 41 |
| 1067 | SGWGMDVTPQVGWLTGWVEK | 26.61 | 745.03 | 1018.54 | 41 |
| 1068 | SGWGMDVTPQVGWLTGWVEK | 26.61 | 745.03 | 1075.56 | 41 |
| 1069 | SIHPASTFK | 10.74 | 494.27 | 650.35 | 27 |
| 1070 | SIHPASTFK | 10.73 | 494.27 | 787.41 | 27 |
| 1071 | SIHPASTFK | 10.73 | 494.27 | 900.49 | 27 |
| 1072 | SISTK | 10.41 | 268.16 | 335.19 | 17 |
| 1073 | SISTK | 10.42 | 268.16 | 389.2 | 17 |
| 1074 | SISTK | 10.42 | 268.16 | 448.28 | 17 |
| 1075 | SLGLSNNLSR | 14.23 | 530.79 | 690.35 | 28 |
| 1076 | SLGLSNNLSR | 14.23 | 530.79 | 803.44 | 28 |
| 1077 | SLGLSNNLSR | 14.23 | 530.79 | 860.46 | 28 |
| 1078 | SLSMSGK | 9.31 | 355.18 | 509.24 | 21 |
| 1079 | SLSMSGK | 9.32 | 355.18 | 563.25 | 21 |
| 1080 | SLSMSGK | 9.32 | 355.18 | 622.32 | 21 |
| 1081 | SMLFIEEK | 17.82 | 498.76 | 518.28 | 27 |
| 1082 | SMLFIEEK | 17.82 | 498.76 | 665.35 | 27 |
| 1083 | SMLFIEEK | 17.82 | 498.76 | 778.43 | 27 |
| 1084 | SNGLTHSWLGSSLK | 16.78 | 743.89 | 877.48 | 38 |
| 1085 | SNGLTHSWLGSSLK | 16.78 | 743.89 | 1014.54 | 38 |
| 1086 | SNGLTHSWLGSSLK | 16.78 | 743.89 | 1115.58 | 38 |
| 1087 | SPTWELKPEYNPSPR | 16.02 | 600.97 | 733.36 | 34 |
| 1088 | SPTWELKPEYNPSPR | 16.02 | 600.97 | 808.91 | 34 |
| 1089 | SPTWELKPEYNPSPR | 16.02 | 600.97 | 959.46 | 34 |
| 1090 | SQDIVR | 8.4 | 359.2 | 502.3 | 21 |
| 1091 | SQDIVR | 8.38 | 359.2 | 543.28 | 21 |
| 1092 | SQDIVR | 8.4 | 359.2 | 630.36 | 21 |
| 1093 | SQQKPTDPTIWLK | 16.6 | 514.62 | 660.41 | 30 |
| 1094 | SQQKPTDPTIWLK | 16.6 | 514.62 | 757.46 | 30 |
| 1095 | SQQKPTDPTIWLK | 16.6 | 514.62 | 785.38 | 30 |
| 1096 | SQVGWLTGWVEQPDGK | 22.27 | 893.94 | 1015.5 | 44 |
| 1097 | SQVGWLTGWVEQPDGK | 22.28 | 893.94 | 1116.53 | 44 |

TABLE 25-continued

| Transition number | Peptide | Retention time (minutes) | (m/z) filtered in Q1 | (m/z) filtered in Q3 | Collision energy (eV) |
|---|---|---|---|---|---|
| 1098 | SQVGWLTGWVEQPDGK | 22.28 | 893.94 | 1229.62 | 44 |
| 1099 | SSSNSC[CAM]TTNNAAR | 16.84 | 685.29 | 907.41 | 35 |
| 1100 | SSSNSC[CAM]TTNNAAR | 16.85 | 685.29 | 994.44 | 35 |
| 1101 | SSSNSC[CAM]TTNNAAR | 16.84 | 685.29 | 1108.48 | 35 |
| 1102 | SVYGELR | 12.65 | 412.22 | 417.25 | 23 |
| 1103 | SVYGELR | 12.65 | 412.22 | 474.27 | 23 |
| 1104 | SVYGELR | 12.65 | 412.22 | 637.33 | 23 |
| 1105 | SWILR | 16.33 | 337.7 | 401.29 | 20 |
| 1106 | SWILR | 16.32 | 337.7 | 500.29 | 20 |
| 1107 | SWILR | 16.33 | 337.7 | 587.37 | 20 |
| 1108 | SYLEK | 9.09 | 320.17 | 389.24 | 19 |
| 1109 | SYLEK | 9.09 | 320.17 | 493.23 | 19 |
| 1110 | SYLEK | 9.1 | 320.17 | 552.3 | 19 |
| 1111 | TAYIPASTFK | 15.43 | 549.8 | 650.35 | 29 |
| 1112 | TAYIPASTFK | 15.43 | 549.8 | 763.43 | 29 |
| 1113 | TAYIPASTFK | 15.43 | 549.8 | 926.5 | 29 |
| 1114 | TDDLFK | 13.48 | 369.69 | 407.27 | 21 |
| 1115 | TDDLFK | 13.48 | 369.69 | 522.29 | 21 |
| 1116 | TDDLFK | 13.48 | 369.69 | 637.32 | 21 |
| 1117 | TDINEIFK | 17.44 | 490.26 | 650.35 | 27 |
| 1118 | TDINEIFK | 17.44 | 490.26 | 763.43 | 27 |
| 1119 | TDINEIFK | 17.44 | 490.26 | 878.46 | 27 |
| 1120 | TFIHNDPR | 18.92 | 500.25 | 751.38 | 27 |
| 1121 | TFIHNDPR | 18.92 | 500.25 | 825.39 | 27 |
| 1122 | TFIHNDPR | 18.92 | 500.25 | 898.45 | 27 |
| 1123 | TGAGFTANR | 9.64 | 447.72 | 461.25 | 25 |
| 1124 | TGAGFTANR | 9.64 | 447.72 | 665.34 | 25 |
| 1125 | TGAGFTANR | 9.64 | 447.72 | 793.4 | 25 |
| 1126 | TGFNDGQK | 7.5 | 433.7 | 561.26 | 24 |
| 1127 | TGFNDGQK | 7.5 | 433.7 | 708.33 | 24 |
| 1128 | TGFNDGQK | 7.5 | 433.7 | 765.35 | 24 |
| 1129 | TGLADSK | 9.7 | 346.18 | 533.29 | 20 |
| 1130 | TGLADSK | 9.67 | 346.18 | 545.26 | 20 |
| 1131 | TGLADSK | 9.7 | 346.18 | 590.31 | 20 |
| 1132 | TGLDLMQK | 15.32 | 453.24 | 634.32 | 25 |
| 1133 | TGLDLMQK | 15.32 | 453.24 | 747.41 | 25 |
| 1134 | TGLDLMQK | 15.32 | 453.24 | 804.43 | 25 |
| 1135 | TGLELMQK | 15.03 | 460.25 | 648.34 | 25 |

TABLE 25-continued

| Transition number | Peptide | Retention time (minutes) | (m/z) filtered in Q1 | (m/z) filtered in Q3 | Collision energy (eV) |
|---|---|---|---|---|---|
| 1136 | TGLELMQK | 15.03 | 460.25 | 761.42 | 25 |
| 1137 | TGLELMQK | 15.03 | 460.25 | 818.44 | 25 |
| 1138 | TGMGYPK | 10.28 | 377.18 | 464.25 | 22 |
| 1139 | TGMGYPK | 10.28 | 377.18 | 595.29 | 22 |
| 1140 | TGMGYPK | 10.28 | 377.18 | 652.31 | 22 |
| 1141 | TGNGR | 0.8 | 252.63 | 330.14 | 16 |
| 1142 | TGNGR | 0.8 | 252.63 | 346.18 | 16 |
| 1143 | TGNGR | 0.81 | 252.63 | 403.2 | 16 |
| 1144 | TGTGSFIDAR | 13.35 | 512.76 | 708.37 | 28 |
| 1145 | TGTGSFIDAR | 13.35 | 512.76 | 765.39 | 28 |
| 1146 | TGTGSFIDAR | 13.35 | 512.76 | 866.44 | 28 |
| 1147 | TGTGSLSDAK | 8.32 | 468.74 | 620.32 | 26 |
| 1148 | TGTGSLSDAK | 8.32 | 468.74 | 677.35 | 26 |
| 1149 | TGTGSLSDAK | 8.32 | 468.74 | 778.39 | 26 |
| 1150 | TGVATEYQPEIGWWAGWVER | 25.49 | 779.04 | 903.45 | 43 |
| 1151 | TGVATEYQPEIGWWAGWVER | 25.5 | 779.04 | 1146.55 | 43 |
| 1152 | TGVATEYQPEIGWWAGWVER | 25.52 | 1168.06 | 1189.57 | 56 |
| 1153 | TGVSYPLLADGTR | 17.4 | 675.36 | 842.47 | 35 |
| 1154 | TGVSYPLLADGTR | 17.41 | 675.36 | 1005.54 | 35 |
| 1155 | TGVSYPLLADGTR | 17.4 | 675.36 | 1092.57 | 35 |
| 1156 | TGWAMDIK | 16.71 | 461.23 | 577.3 | 25 |
| 1157 | TGWAMDIK | 16.71 | 461.23 | 763.38 | 25 |
| 1158 | TGWAMDIK | 16.72 | 461.23 | 820.4 | 25 |
| 1159 | TGWATR | 9.71 | 346.18 | 517.24 | 20 |
| 1160 | TGWATR | 9.69 | 346.18 | 533.28 | 20 |
| 1161 | TGWATR | 9.69 | 346.18 | 590.3 | 20 |
| 1162 | TGWC[CAM]FDC[CAM]TPELGWWVGWVK | 28.39 | 795.36 | 960.51 | 44 |
| 1163 | TGWC[CAM]FDC[CAM]TPELGWWVGWVK | 28.39 | 795.36 | 1017.53 | 44 |
| 1164 | TGWC[CAM]FDC[CAM]TPELGWWVGWVK | 28.38 | 795.36 | 1028.36 | 44 |
| 1165 | TGWEGR | 9.1 | 353.17 | 531.22 | 21 |
| 1166 | TGWEGR | 9.09 | 353.17 | 547.26 | 21 |
| 1167 | TGWEGR | 9.09 | 353.17 | 604.28 | 21 |
| 1168 | TGWFVDK | 16.08 | 426.72 | 694.36 | 24 |
| 1169 | TGWFVDK | 16.1 | 426.72 | 706.32 | 24 |
| 1170 | TGWFVDK | 16.08 | 426.72 | 751.38 | 24 |
| 1171 | TGYDTK | 2.09 | 342.66 | 526.25 | 20 |
| 1172 | TGYDTK | 2.09 | 342.66 | 538.21 | 20 |
| 1173 | TGYDTK | 2.08 | 342.66 | 583.27 | 20 |

TABLE 25-continued

| Transition number | Peptide | Retention time (minutes) | (m/z) filtered in Q1 | (m/z) filtered in Q3 | Collision energy (eV) |
|---|---|---|---|---|---|
| 1174 | TGYGVR | 8.09 | 326.67 | 478.23 | 19 |
| 1175 | TGYGVR | 8.1 | 326.67 | 494.27 | 19 |
| 1176 | TGYGVR | 8.1 | 326.67 | 551.29 | 19 |
| 1177 | TGYSAR | 2.24 | 327.66 | 480.21 | 19 |
| 1178 | TGYSAR | 2.24 | 327.66 | 496.25 | 19 |
| 1179 | TGYSAR | 2.24 | 327.66 | 553.27 | 19 |
| 1180 | TGYSTR | 2.08 | 342.67 | 510.22 | 20 |
| 1181 | TGYSTR | 2.08 | 342.67 | 526.26 | 20 |
| 1182 | TGYSTR | 2.08 | 342.67 | 583.28 | 20 |
| 1183 | THESSNWGK | 5.36 | 523.24 | 678.32 | 28 |
| 1184 | THESSNWGK | 5.37 | 523.24 | 807.36 | 28 |
| 1185 | THESSNWGK | 5.37 | 523.24 | 944.42 | 28 |
| 1186 | TIC[CAM]TAIADAGTGK | 14.35 | 639.82 | 732.39 | 33 |
| 1187 | TIC[CAM]TAIADAGTGK | 14.35 | 639.82 | 904.47 | 33 |
| 1188 | TIC[CAM]TAIADAGTGK | 14.35 | 639.82 | 1064.5 | 33 |
| 1189 | TIGGAPDAYWVDDSLQISAR | 21.22 | 712.35 | 1004.5 | 40 |
| 1190 | TIGGAPDAYWVDDSLQISAR | 21.22 | 712.35 | 1103.57 | 40 |
| 1191 | TIGGAPDAYWVDDSLQISAR | 21.21 | 1068.02 | 1103.57 | 52 |
| 1192 | TLPFSASSYETLR | 18.73 | 736.37 | 855.42 | 37 |
| 1193 | TLPFSASSYETLR | 18.73 | 736.37 | 1013.49 | 37 |
| 1194 | TLPFSASSYETLR | 18.73 | 736.37 | 1160.56 | 37 |
| 1195 | TLPFSPK | 15 | 395.23 | 478.27 | 22 |
| 1196 | TLPFSPK | 15 | 395.23 | 575.32 | 22 |
| 1197 | TLPFSPK | 15 | 395.23 | 688.4 | 22 |
| 1198 | TLPFSQEVQDEVQSILFIEEK | 28.55 | 827.09 | 891.52 | 45 |
| 1199 | TLPFSQEVQDEVQSILFIEEK | 28.56 | 827.09 | 978.55 | 45 |
| 1200 | TLPFSQEVQDEVQSILFIEEK | 28.56 | 827.09 | 1106.61 | 45 |
| 1201 | TLPFSQEVQDEVQSMLFIEEK | 27.7 | 833.08 | 996.51 | 46 |
| 1202 | TLPFSQEVQDEVQSMLFIEEK | 27.69 | 833.08 | 1124.57 | 46 |
| 1203 | TLPFSQEVQDEVQSMLFIEEK | 27.7 | 833.08 | 1223.63 | 46 |
| 1204 | TLQNGWFEGFIISK | 24.12 | 820.43 | 940.51 | 41 |
| 1205 | TLQNGWFEGFIISK | 24.11 | 820.43 | 1126.59 | 41 |
| 1206 | TLQNGWFEGFIISK | 24.11 | 820.43 | 1183.61 | 41 |
| 1207 | TMQEYLNK | 12.6 | 513.75 | 666.35 | 28 |
| 1208 | TMQEYLNK | 12.6 | 513.75 | 794.4 | 28 |
| 1209 | TMQEYLNK | 12.6 | 513.75 | 925.44 | 28 |
| 1210 | TQTYQAYDAAR | 11.2 | 644.3 | 666.32 | 33 |
| 1211 | TQTYQAYDAAR | 11.2 | 644.3 | 957.44 | 33 |

TABLE 25-continued

| Transition number | Peptide | Retention time (minutes) | (m/z) filtered in Q1 | (m/z) filtered in Q3 | Collision energy (eV) |
|---|---|---|---|---|---|
| 1212 | TQTYQAYDAAR | 11.2 | 644.3 | 1058.49 | 33 |
| 1213 | TTDPTIWEK | 14.39 | 545.77 | 676.37 | 29 |
| 1214 | TTDPTIWEK | 14.39 | 545.77 | 773.42 | 29 |
| 1215 | TTDPTIWEK | 14.39 | 545.77 | 888.45 | 29 |
| 1216 | TTTTEVFK | 12.06 | 463.75 | 522.29 | 25 |
| 1217 | TTTTEVFK | 12.06 | 463.75 | 623.34 | 25 |
| 1218 | TTTTEVFK | 12.06 | 463.75 | 724.39 | 25 |
| 1219 | TWASNDFSR | 13.73 | 542.25 | 638.29 | 29 |
| 1220 | TWASNDFSR | 13.73 | 542.25 | 725.32 | 29 |
| 1221 | TWASNDFSR | 13.73 | 542.25 | 796.36 | 29 |
| 1222 | TWDMVQR | 14.28 | 468.22 | 648.31 | 26 |
| 1223 | TWDMVQR | 14.28 | 468.22 | 761.33 | 26 |
| 1224 | TWDMVQR | 14.28 | 468.22 | 834.39 | 26 |
| 1225 | TYVVDPAR | 12.15 | 460.75 | 557.3 | 25 |
| 1226 | TYVVDPAR | 12.14 | 460.75 | 656.37 | 25 |
| 1227 | TYVVDPAR | 12.15 | 460.75 | 819.44 | 25 |
| 1228 | VAFSLNIEMK | 20.65 | 576.31 | 747.41 | 30 |
| 1229 | VAFSLNIEMK | 20.65 | 576.31 | 834.44 | 30 |
| 1230 | VAFSLNIEMK | 20.65 | 576.31 | 981.51 | 30 |
| 1231 | VANSLIGLSTGAVR | 17.97 | 679.39 | 760.43 | 35 |
| 1232 | VANSLIGLSTGAVR | 17.97 | 679.39 | 873.52 | 35 |
| 1233 | VANSLIGLSTGAVR | 17.97 | 679.39 | 986.6 | 35 |
| 1234 | VELGK | 7.74 | 273.17 | 342.2 | 17 |
| 1235 | VELGK | 7.75 | 273.17 | 399.22 | 17 |
| 1236 | VELGK | 7.74 | 273.17 | 446.26 | 17 |
| 1237 | VFLDSWAK | 18.2 | 483.26 | 606.29 | 26 |
| 1238 | VFLDSWAK | 18.2 | 483.26 | 719.37 | 26 |
| 1239 | VFLDSWAK | 18.2 | 483.26 | 866.44 | 26 |
| 1240 | VFLESWAK | 18.11 | 490.27 | 620.3 | 27 |
| 1241 | VFLESWAK | 18.11 | 490.27 | 733.39 | 27 |
| 1242 | VFLESWAK | 18.11 | 490.27 | 880.46 | 27 |
| 1243 | VFLSSWAQDMNLSSAIK | 23.66 | 948.98 | 978.49 | 47 |
| 1244 | VFLSSWAQDMNLSSAIK | 23.66 | 948.98 | 1106.55 | 47 |
| 1245 | VFLSSWAQDMNLSSAIK | 23.66 | 948.98 | 1177.59 | 47 |
| 1246 | VGFER | 10.32 | 304.16 | 433.21 | 18 |
| 1247 | VGFER | 10.32 | 304.16 | 451.23 | 18 |
| 1248 | VGFER | 10.32 | 304.16 | 508.25 | 18 |
| 1249 | VILVFDQVR | 19.69 | 544.83 | 664.34 | 29 |

TABLE 25-continued

| Transition number | Peptide | Retention time (minutes) | (m/z) filtered in Q1 | (m/z) filtered in Q3 | Collision energy (eV) |
|---|---|---|---|---|---|
| 1250 | VILVFDQVR | 19.69 | 544.83 | 763.41 | 29 |
| 1251 | VILVFDQVR | 19.69 | 544.83 | 876.49 | 29 |
| 1252 | VMAAMVR | 12.3 | 389.21 | 476.26 | 22 |
| 1253 | VMAAMVR | 12.3 | 389.21 | 547.3 | 22 |
| 1254 | VMAAMVR | 12.3 | 389.21 | 678.34 | 22 |
| 1255 | VPLAVMGYDAGILVDAHNPR | 21.61 | 703.37 | 709.34 | 39 |
| 1256 | VPLAVMGYDAGILVDAHNPR | 21.61 | 703.37 | 808.41 | 39 |
| 1257 | VPLAVMGYDAGILVDAHNPR | 21.61 | 703.37 | 921.49 | 39 |
| 1258 | VQDEVQSMLFIEEK | 20.48 | 847.92 | 996.51 | 42 |
| 1259 | VQDEVQSMLFIEEK | 20.48 | 847.92 | 1124.57 | 42 |
| 1260 | VQDEVQSMLFIEEK | 20.47 | 847.92 | 1223.63 | 42 |
| 1261 | VQDGVQSMLFIEEK | 20.26 | 811.91 | 996.51 | 41 |
| 1262 | VQDGVQSMLFIEEK | 20.27 | 811.91 | 1124.57 | 41 |
| 1263 | VQDGVQSMLFIEEK | 20.25 | 811.91 | 1223.63 | 41 |
| 1264 | VSC[CAM]LPC[CAM]YQWSHK | 14.32 | 526.26 | 569.34 | 30 |
| 1265 | VSC[CAM]LPC[CAM]YQWSHK | 14.32 | 526.26 | 860.46 | 30 |
| 1266 | VSC[CAM]LPC[CAM]YQWSHK | 14.31 | 526.26 | 1020.49 | 30 |
| 1267 | VSC[CAM]VWC[CAM]YQALAR | 18.41 | 756.86 | 881.43 | 38 |
| 1268 | VSC[CAM]VWC[CAM]YQALAR | 18.41 | 756.86 | 1067.51 | 38 |
| 1269 | VSC[CAM]VWC[CAM]YQALAR | 18.41 | 756.86 | 1166.58 | 38 |
| 1270 | VSDVC[CAM]SEVTAEGWQEVR | 17.33 | 650.97 | 774.39 | 37 |
| 1271 | VSDVC[CAM]SEVTAEGWQEVR | 17.34 | 975.95 | 1075.52 | 48 |
| 1272 | VSDVC[CAM]SEVTAEGWQEVR | 17.34 | 975.95 | 1174.59 | 48 |
| 1273 | VSEVEGWQIHGK | 13.92 | 456.9 | 582.34 | 27 |
| 1274 | VSEVEGWQIHGK | 13.92 | 456.9 | 768.42 | 27 |
| 1275 | VSEVEGWQIHGK | 13.92 | 456.9 | 825.44 | 27 |
| 1276 | VSFSLNIEMK | 20.65 | 584.31 | 834.44 | 31 |
| 1277 | VSFSLNIEMK | 20.64 | 584.31 | 981.51 | 31 |
| 1278 | VSFSLNIEMK | 20.65 | 584.31 | 1068.54 | 31 |
| 1279 | VSPC[CAM]SSFK | 11.04 | 456.22 | 468.25 | 25 |
| 1280 | VSPC[CAM]SSFK | 11.04 | 456.22 | 628.28 | 25 |
| 1281 | VSPC[CAM]SSFK | 11.04 | 456.22 | 725.33 | 25 |
| 1282 | VSQVPAYK | 10.68 | 446.25 | 478.27 | 25 |
| 1283 | VSQVPAYK | 10.68 | 446.25 | 577.33 | 25 |
| 1284 | VSQVPAYK | 10.68 | 446.25 | 705.39 | 25 |
| 1285 | VVFAR | 11.17 | 296.18 | 393.22 | 18 |
| 1286 | VVFAR | 11.17 | 296.18 | 417.25 | 18 |
| 1287 | VVFAR | 11.17 | 296.18 | 492.29 | 18 |

TABLE 25-continued

| Transition number | Peptide | Retention time (minutes) | (m/z) filtered in Q1 | (m/z) filtered in Q3 | Collision energy (eV) |
|---|---|---|---|---|---|
| 1288 | WDGAK | 4.9 | 288.64 | 302.11 | 18 |
| 1289 | WDGAK | 4.9 | 288.64 | 390.2 | 18 |
| 1290 | WDGAK | 4.9 | 288.644 | 30.17 | 18 |
| 1291 | WDGHIYDFPDWNR | 20.52 | 574.25 | 590.27 | 33 |
| 1292 | WDGHIYDFPDWNR | 20.52 | 574.25 | 687.32 | 33 |
| 1293 | WDGHIYDFPDWNR | 20.52 | 574.25 | 887.37 | 33 |
| 1294 | WDGIK | 12.03 | 309.67 | 359.13 | 19 |
| 1295 | WDGIK | 12.03 | 309.67 | 432.25 | 19 |
| 1296 | WDGIK | 12.03 | 309.67 | 472.22 | 19 |
| 1297 | WDGKPR | 6.36 | 379.74 | 57.29 | 22 |
| 1298 | WDGKPR | 6.35 | 379.75 | 72.32 | 22 |
| 1299 | WDGKPR | 6.36 | 379.75 | 84.28 | 22 |
| 1300 | WDGQTR | 7.41 | 381.68 | 461.25 | 22 |
| 1301 | WDGQTR | 7.41 | 381.68 | 576.27 | 22 |
| 1302 | WDGQTR | 7.41 | 381.68 | 588.24 | 22 |
| 1303 | WDGVK | 10.1 | 302.66 | 359.13 | 18 |
| 1304 | WDGVK | 10.1 | 302.66 | 418.23 | 18 |
| 1305 | WDGVK | 10.1 | 302.66 | 458.2 | 18 |
| 1306 | WDGVNR | 10.39 | 373.68 | 445.25 | 21 |
| 1307 | WDGVNR | 10.39 | 373.68 | 560.28 | 21 |
| 1308 | WDGVNR | 10.42 | 373.68 | 572.25 | 21 |
| 1309 | YAQAK | 12.58 | 290.66 | 363.17 | 18 |
| 1310 | YAQAK | 12.58 | 290.66 | 417.25 | 18 |
| 1311 | YAQAK | 12.58 | 290.66 | 434.2 | 18 |
| 1312 | YFSDFNAK | 14.21 | 496.23 | 681.32 | 27 |
| 1313 | YFSDFNAK | 14.21 | 496.23 | 828.39 | 27 |
| 1314 | YFSDFNAK | 14.21 | 496.23 | 828.39 | 27 |
| 1315 | YGTHLDR | 8.51 | 431.21 | 641.34 | 24 |
| 1316 | YGTHLDR | 8.52 | 431.21 | 687.31 | 24 |
| 1317 | YGTHLDR | 8.51 | 431.21 | 698.36 | 24 |
| 1318 | YLDELVK | 15.52 | 440.24 | 488.31 | 24 |
| 1319 | YLDELVK | 15.53 | 440.24 | 603.33 | 24 |
| 1320 | YLDELVK | 15.52 | 440.24 | 716.42 | 24 |
| 1321 | YLMITEAGR | 15.86 | 527.27 | 533.27 | 28 |

TABLE 25-continued

| Transition number | Peptide | Retention time (minutes) | (m/z) filtered in Q1 | (m/z) filtered in Q3 | Collision energy (eV) |
|---|---|---|---|---|---|
| 1322 | YLMITEAGR | 15.86 | 527.27 | 646.35 | 28 |
| 1323 | YLMITEAGR | 15.86 | 527.27 | 777.39 | 28 |
| 1324 | YLNLFSYGNANIGGGIDK | 22.16 | 639.32 | 773.42 | 36 |
| 1325 | YLNLFSYGNANIGGGIDK | 22.16 | 958.48 | 1015.52 | 47 |
| 1326 | YLNLFSYGNANIGGGIDK | 22.16 | 958.48 | 1178.58 | 47 |
| 1327 | YPVVWYSQQVAHHLGAQR | 18.11 | 535.53 | 544.32 | 30 |
| 1328 | YPVVWYSQQVAHHLGAQR | 18.11 | 535.53 | 681.38 | 30 |
| 1329 | YPVVWYSQQVAHHLGAQR | 18.11 | 535.53 | 889.48 | 30 |
| 1330 | YSNVLAFK | 16.44 | 471.26 | 478.3 | 26 |
| 1331 | YSNVLAFK | 16.44 | 471.26 | 691.41 | 26 |
| 1332 | YSNVLAFK | 16.44 | 471.26 | 778.45 | 26 |
| 1333 | YSPASTFK | 12.22 | 450.73 | 553.3 | 25 |
| 1334 | YSPASTFK | 12.22 | 450.73 | 650.35 | 25 |
| 1335 | YSPASTFK | 12.22 | 450.73 | 737.38 | 25 |
| 1336 | YSVVPVYQQLAR | 18.42 | 711.89 | 778.42 | 36 |
| 1337 | YSVVPVYQQLAR | 18.42 | 711.89 | 974.54 | 36 |
| 1338 | YSVVPVYQQLAR | 18.43 | 711.89 | 1073.61 | 36 |
| 1339 | YSVVWYSQLTAK | 19.75 | 722.88 | 810.44 | 37 |
| 1340 | YSVVWYSQLTAK | 19.76 | 722.88 | 996.51 | 37 |
| 1341 | YSVVWYSQLTAK | 19.76 | 722.88 | 1095.58 | 37 |
| 1342 | YSVVWYSQQVAHHLGAQR | 18.61 | 533.02 | 544.32 | 30 |
| 1343 | YSVVWYSQQVAHHLGAQR | 18.61 | 533.02 | 681.38 | 30 |
| 1344 | YSVVWYSQQVAHHLGAQR | 18.61 | 533.02 | 889.48 | 30 |
| 1345 | YTPASTFK | 11.95 | 305.49 | 553.3 | 19 |
| 1346 | YTPASTFK | 11.98 | 457.73 | 553.3 | 25 |
| 1347 | YTPASTFK | 11.98 | 457.73 | 650.35 | 25 |
| 1348 | YTSAFGYGNADVSGEPGK | 15.03 | 607.28 | 673.35 | 34 |
| 1349 | YTSAFGYGNADVSGEPGK | 15.02 | 607.28 | 788.38 | 34 |
| 1350 | YTSAFGYGNADVSGEPGK | 15.02 | 910.41 | 1030.48 | 45 |
| 1351 | YVFVSALTGNLGSNLTSSIK | 23.66 | 691.04 | 906.49 | 39 |
| 1352 | YVFVSALTGNLGSNLTSSIK | 23.66 | 1036.06 | 1165.63 | 51 |
| 1353 | YVFVSALTGNLGSNLTSSIK | 23.67 | 1036.06 | 1190.64 | 51 |
| 1354 | YVFVSALTGSLGSNLTSSIK | 24.04 | 682.04 | 906.49 | 38 |
| 1355 | YVFVSALTGSLGSNLTSSIK | 24.04 | 1022.55 | 1106.61 | 50 |
| 1356 | YVFVSALTGSLGSNLTSSIK | 24.04 | 1022.55 | 1163.63 | 50 |

The areas obtained for each of the transitions and for each of the microorganisms studied were measured. When the areas of the three transitions of the same peptide are greater than or equal to 2500, the detection of the peptide is considered to be positive and is labelled "1". When at least one transition comprises an area less than 2500, the corresponding peptide is considered non-detected and is labelled "0".

EXAMPLE 17

Identification of a Resistance to IMP Beta-Lactams

Samples Sam145 to Sam154 are identified according to one of the methods described in examples 1, 3 or 4. The identification of the species is set out in TABLE 26.

TABLE 26

| Names | Species |
| --- | --- |
| Sam145 | A. baumannii |
| Sam146 | A. baumannii |
| Sam147 | E. coli |
| Sam148 | K. pneumoniae |
| Sam149 | K. pneumoniae |
| Sam150 | P. aeruginosa |
| Sam151 | P. aeruginosa |
| Sam152 | P. aeruginosa |
| Sam153 | P. aeruginosa |
| Sam154 | P. putida |

Samples Sam145 to Sam154 correspond to a species able to comprise an IMP resistance mechanism. The following method is then performed to detect such a mechanism.

Each sample is treated according to Example 5, then analysed according to Example 6 unless otherwise stated in the rest of the example, by detecting the peptides from TABLE 27 instead of the peptides from TABLE 3.

TABLE 27

| Transition number | Peptide | Retention time (minutes) | (m/z) filtered in Q1 | (m/z) filtered in Q3 | Collision energy (eV) | Positivity threshold |
| --- | --- | --- | --- | --- | --- | --- |
| 1 | DTENLVNWFVER | 24.3 | 761.37 | 550.3 | 39.1 | 2000 |
| 2 | DTENLVNWFVER | 24.3 | 761.37 | 850.42 | 39.1 | 2000 |
| 3 | DTENLVNWFVER | 24.3 | 761.37 | 949.49 | 39.1 | 2000 |
| 4 | GDASLMK | 10.6 | 361.18 | 391.24 | 16.3 | 2000 |
| 5 | GDASLMK | 10.6 | 361.18 | 478.27 | 16.3 | 2000 |
| 6 | GDASLMK | 10.6 | 361.18 | 549.31 | 16.3 | 2000 |
| 7 | GFNESK | 2 | 341.16 | 312.65 | 15.2 | 2000 |
| 8 | GFNESK | 2 | 341.16 | 363.19 | 15.2 | 2000 |
| 9 | GFNESK | 2 | 341.16 | 477.23 | 15.2 | 2000 |
| 10 | GLNESK | 1.1 | 324.17 | 363.19 | 14.2 | 2000 |
| 11 | GLNESK | 1.1 | 324.17 | 477.23 | 14.2 | 2000 |
| 12 | GLNESK | 1.1 | 324.17 | 590.31 | 14.2 | 2000 |
| 13 | GLNESR | 2.2 | 338.18 | 309.66 | 15 | 2000 |
| 14 | GLNESR | 2.2 | 338.18 | 391.19 | 15 | 2000 |
| 15 | GLNESR | 2.1 | 338.18 | 505.24 | 15 | 2000 |
| 16 | GVYVHTSFEEVK | 15.1 | 465.57 | 488.74 | 21.5 | 2000 |
| 17 | GVYVHTSFEEVK | 15.1 | 465.57 | 538.28 | 21.5 | 2000 |
| 18 | GVYVHTSFEEVK | 15.1 | 465.57 | 619.81 | 21.5 | 2000 |
| 19 | GWGVVTK | 14.3 | 373.71 | 345.2 | 17 | 2000 |
| 20 | GWGVVTK | 14.3 | 373.71 | 347.23 | 17 | 2000 |
| 21 | GWGVVTK | 14.3 | 373.71 | 503.32 | 17 | 2000 |
| 22 | GWSVVTK | 14.2 | 388.72 | 347.23 | 17.9 | 2000 |
| 23 | GWSVVTK | 14.2 | 388.72 | 446.3 | 17.9 | 2000 |
| 24 | GWSVVTK | 14.2 | 388.72 | 533.33 | 17.9 | 2000 |
| 25 | HGLVVLVK | 15.4 | 432.79 | 557.4 | 20.4 | 2000 |
| 26 | HGLVVLVK | 15.5 | 432.79 | 670.49 | 20.4 | 2000 |
| 27 | HGLVVLVK | 15.4 | 432.79 | 727.51 | 20.4 | 2000 |
| 28 | HSFNGVSYSLIK | 17 | 451.24 | 460.31 | 21.1 | 2000 |

TABLE 27-continued

| Transition number | Peptide | Retention time (minutes) | (m/z) filtered in Q1 | (m/z) filtered in Q3 | Collision energy (eV) | Positivity threshold |
|---|---|---|---|---|---|---|
| 29 | HSFNGVSYSLIK | 17 | 451.24 | 623.38 | 21.1 | 2000 |
| 30 | HSFNGVSYSLIK | 17 | 451.24 | 710.41 | 21.1 | 2000 |
| 31 | LEEGVYVHTSFEEVK | 16.9 | 589.29 | 697.85 | 25.4 | 2000 |
| 32 | LEEGVYVHTSFEEVK | 16.9 | 589.29 | 762.37 | 25.4 | 2000 |
| 33 | LEEGVYVHTSFEEVK | 16.9 | 589.29 | 826.89 | 25.4 | 2000 |
| 34 | LFVLCVCFLCSITAAGAR | 19.5 | 686.68 | 659.38 | 28.4 | 2000 |
| 35 | LFVLCVCFLCSITAAGAR | 19.6 | 686.68 | 906.45 | 28.4 | 2000 |
| 36 | LFVLCVCFLCSITAAGAR | 19.5 | 1029.52 | 374.22 | 54.4 | 2000 |
| 37 | LFVLCVCFLCSITAAGAR | 19.5 | 1029.52 | 659.38 | 54.4 | 2000 |
| 38 | LTLEQAVK | 15.2 | 451.27 | 574.32 | 21.5 | 2000 |
| 39 | LTLEQAVK | 15.2 | 451.27 | 687.4 | 21.5 | 2000 |
| 40 | LTLEQAVK | 15.2 | 451.27 | 788.45 | 21.5 | 2000 |
| 41 | LTWEQAVK | 16.3 | 487.77 | 574.32 | 23.5 | 2000 |
| 42 | LTWEQAVK | 16.3 | 487.77 | 760.4 | 23.5 | 2000 |
| 43 | LTWEQAVK | 16.3 | 487.77 | 861.45 | 23.5 | 2000 |
| 44 | LTWEQTVK | 15.4 | 502.77 | 395.71 | 24.4 | 2000 |
| 45 | LTWEQTVK | 15.4 | 502.77 | 604.33 | 24.4 | 2000 |
| 46 | LTWEQTVK | 15.4 | 502.77 | 790.41 | 24.4 | 2000 |
| 47 | LVAWFVGR | 21.3 | 474.28 | 478.28 | 22.8 | 2000 |
| 48 | LVAWFVGR | 21.3 | 474.28 | 664.36 | 22.8 | 2000 |
| 49 | LVAWFVGR | 21.3 | 474.28 | 735.39 | 22.8 | 2000 |
| 50 | LVNWFIEHGYR | 20.1 | 478.58 | 611.29 | 21.9 | 2000 |
| 51 | LVNWFIEHGYR | 20.1 | 478.58 | 660.83 | 21.9 | 2000 |
| 52 | LVNWFIEHGYR | 20.1 | 478.58 | 661.31 | 21.9 | 2000 |
| 53 | LVNWFVER | 20.9 | 531.79 | 550.3 | 26 | 2000 |
| 54 | LVNWFVER | 20.9 | 531.79 | 736.38 | 26 | 2000 |
| 55 | LVNWFVER | 20.9 | 531.79 | 850.42 | 26 | 2000 |
| 56 | LVTWFVER | 20.6 | 525.29 | 550.3 | 25.7 | 2000 |
| 57 | LVTWFVER | 20.6 | 525.29 | 736.38 | 25.7 | 2000 |
| 58 | LVTWFVER | 20.6 | 525.29 | 837.43 | 25.7 | 2000 |
| 59 | LVVPGHSEVGDASLLK | 17.6 | 540.97 | 655.34 | 23.9 | 2000 |
| 60 | LVVPGHSEVGDASLLK | 17.6 | 540.97 | 704.88 | 23.9 | 2000 |
| 61 | LVVPGHSEVGDASLLK | 17.6 | 810.95 | 655.34 | 42 | 2000 |
| 62 | LVVPSHSDIGDASLLK | 18 | 550.97 | 670.35 | 24.2 | 2000 |
| 63 | LVVPSHSDIGDASLLK | 18 | 550.97 | 719.88 | 24.2 | 2000 |
| 64 | LVVPSHSDIGDASLLK | 18 | 825.96 | 670.35 | 42.8 | 2000 |
| 65 | LVVPSHSDIGDSSLLK | 17.7 | 556.31 | 678.34 | 24.3 | 2000 |
| 66 | LVVPSHSDIGDSSLLK | 17.7 | 556.31 | 719.39 | 24.3 | 2000 |

TABLE 27-continued

| Transition number | Peptide | Retention time (minutes) | (m/z) filtered in Q1 | (m/z) filtered in Q3 | Collision energy (eV) | Positivity threshold |
|---|---|---|---|---|---|---|
| 67 | LVVPSHSDIGDSSLLK | 17.7 | 556.31 | 727.88 | 24.3 | 2000 |
| 68 | LVVPSHSDVGDASLLK | 17.5 | 546.3 | 663.34 | 24 | 2000 |
| 69 | LVVPSHSDVGDASLLK | 17.5 | 546.3 | 712.87 | 24 | 2000 |
| 70 | LVVPSHSDVGDASLLK | 17.5 | 818.95 | 663.34 | 42.4 | 2000 |
| 71 | LVVPSHSEAGDASLLK | 16.1 | 541.63 | 656.33 | 23.9 | 2000 |
| 72 | LVVPSHSEAGDASLLK | 16.1 | 541.63 | 705.87 | 23.9 | 2000 |
| 73 | LVVPSHSEAGDASLLK | 16.1 | 541.63 | 755.4 | 23.9 | 2000 |
| 74 | LVVPSHSEVGDASLLK | 17.5 | 550.97 | 670.35 | 24.2 | 2000 |
| 75 | LVVPSHSEVGDASLLK | 17.5 | 550.97 | 719.88 | 24.2 | 2000 |
| 76 | LVVPSHSEVGDASLLK | 17.5 | 825.96 | 670.35 | 42.8 | 2000 |
| 77 | LVVSGHSEIGNASLLK | 16.8 | 541.97 | 656.85 | 23.9 | 2000 |
| 78 | LVVSGHSEIGNASLLK | 16.8 | 541.97 | 706.38 | 23.9 | 2000 |
| 79 | LVVSGHSEIGNASLLK | 16.8 | 541.97 | 755.92 | 23.9 | 2000 |
| 80 | LVVSSHSDIGDVSLLK | 18.9 | 556.98 | 679.35 | 24.3 | 2000 |
| 81 | LVVSSHSDIGDVSLLK | 18.9 | 556.98 | 728.89 | 24.3 | 2000 |
| 82 | LVVSSHSDIGDVSLLK | 18.9 | 556.98 | 778.42 | 24.3 | 2000 |
| 83 | LVVSSHSEIGDASLLK | 17.6 | 552.31 | 672.34 | 24.2 | 2000 |
| 84 | LVVSSHSEIGDASLLK | 17.6 | 552.31 | 721.88 | 24.2 | 2000 |
| 85 | LVVSSHSEIGDASLLK | 17.6 | 552.31 | 771.41 | 24.2 | 2000 |
| 86 | LVVSSHSEIGNASLLQR | 16.8 | 604 | 416.26 | 25.8 | 2000 |
| 87 | LVVSSHSEIGNASLLQR | 16.8 | 604 | 616.38 | 25.8 | 2000 |
| 88 | LVVSSHSEIGNASLLQR | 16.8 | 604 | 799.42 | 25.8 | 2000 |
| 89 | LVVSSHSEK | 8.1 | 329.18 | 387.19 | 17.3 | 2000 |
| 90 | LVVSSHSEK | 8.1 | 329.18 | 587.28 | 17.3 | 2000 |
| 91 | LVVSSHSEK | 8.1 | 493.27 | 773.38 | 23.9 | 2000 |
| 92 | LVVSSHSETGNASLLK | 14.7 | 547.97 | 665.83 | 24.1 | 2000 |
| 93 | LVVSSHSETGNASLLK | 14.7 | 547.97 | 715.37 | 24.1 | 2000 |
| 94 | LVVSSHSETGNASLLK | 14.7 | 547.97 | 764.9 | 24.1 | 2000 |
| 95 | NDAYLIDTPITAK | 18.8 | 717.88 | 745.41 | 36.7 | 2000 |
| 96 | NDAYLIDTPITAK | 18.8 | 717.88 | 858.49 | 36.7 | 2000 |
| 97 | NDAYLIDTPITAK | 18.8 | 717.88 | 971.58 | 36.7 | 2000 |
| 98 | NSFGGVNYWLVK | 21.4 | 692.36 | 822.45 | 35.2 | 2000 |
| 99 | NSFGGVNYWLVK | 21.4 | 692.36 | 1035.56 | 35.2 | 2000 |
| 100 | NSFGGVNYWLVK | 21.4 | 692.36 | 1182.63 | 35.2 | 2000 |
| 101 | NSFSGASYWLVK | 20.8 | 679.84 | 795.44 | 34.5 | 2000 |
| 102 | NSFSGASYWLVK | 20.8 | 679.84 | 923.5 | 34.5 | 2000 |
| 103 | NSFSGASYWLVK | 20.8 | 679.84 | 1010.53 | 34.5 | 2000 |
| 104 | NSFSGGSYWLVNNK | 18.8 | 786.88 | 375.2 | 40.6 | 2000 |

TABLE 27-continued

| Transition number | Peptide | Retention time (minutes) | (m/z) filtered in Q1 | (m/z) filtered in Q3 | Collision energy (eV) | Positivity threshold |
|---|---|---|---|---|---|---|
| 105 | NSFSGGSYWLVNNK | 18.8 | 786.88 | 474.27 | 40.6 | 2000 |
| 106 | NSFSGGSYWLVNNK | 18.8 | 786.88 | 1224.6 | 40.6 | 2000 |
| 107 | NSFSGVSYWLLK | 23.6 | 700.86 | 809.46 | 35.7 | 2000 |
| 108 | NSFSGVSYWLLK | 23.6 | 700.86 | 1052.58 | 35.7 | 2000 |
| 109 | NSFSGVSYWLLK | 23.6 | 700.86 | 1199.65 | 35.7 | 2000 |
| 110 | NSFSGVSYWLVK | 22.3 | 693.86 | 795.44 | 35.3 | 2000 |
| 111 | NSFSGVSYWLVK | 22.3 | 693.86 | 951.53 | 35.3 | 2000 |
| 112 | NSFSGVSYWLVK | 22.3 | 693.86 | 1038.56 | 35.3 | 2000 |
| 113 | SIPTYASELTNELLK | 23.8 | 560.3 | 717.41 | 24.5 | 2000 |
| 114 | SIPTYASELTNELLK | 23.8 | 560.3 | 739.89 | 24.5 | 2000 |
| 115 | SIPTYASELTNELLK | 23.8 | 839.95 | 739.89 | 43.6 | 2000 |
| 116 | TLEQAVK | 10.5 | 394.73 | 445.28 | 18.2 | 2000 |
| 117 | TLEQAVK | 10.5 | 394.73 | 574.32 | 18.2 | 2000 |
| 118 | TLEQAVK | 10.5 | 394.73 | 687.4 | 18.2 | 2000 |
| 119 | TWEQALK | 15.1 | 438.24 | 459.29 | 20.7 | 2000 |
| 120 | TWEQALK | 15.1 | 438.24 | 588.34 | 20.7 | 2000 |
| 121 | TWEQALK | 15.1 | 438.24 | 774.41 | 20.7 | 2000 |
| 122 | TWEQAVK | 12.8 | 431.23 | 445.28 | 20.3 | 2000 |
| 123 | TWEQAVK | 12.8 | 431.23 | 574.32 | 20.3 | 2000 |
| 124 | TWEQAVK | 12.8 | 431.23 | 760.4 | 20.3 | 2000 |
| 125 | VQATNSFSGVNYWLVK | 22.1 | 604.98 | 708.41 | 25.8 | 2000 |
| 126 | VQATNSFSGVNYWLVK | 22.1 | 604.98 | 822.45 | 25.8 | 2000 |
| 127 | VQATNSFSGVNYWLVK | 22.1 | 906.97 | 1212.64 | 47.4 | 2000 |
| 128 | VQATNSFSGVSYSLIK | 19.9 | 567.63 | 710.41 | 24.7 | 2000 |
| 129 | VQATNSFSGVSYSLIK | 19.9 | 567.63 | 953.53 | 24.7 | 2000 |
| 130 | VQATNSFSGVSYSLIK | 19.9 | 850.95 | 710.41 | 44.2 | 2000 |
| 131 | VQATNSFSGVSYWLVK | 22.5 | 595.98 | 708.41 | 25.6 | 2000 |
| 132 | VQATNSFSGVSYWLVK | 22.5 | 595.98 | 795.44 | 25.6 | 2000 |
| 133 | VQATNSFSGVSYWLVK | 22.5 | 893.46 | 1038.56 | 46.7 | 2000 |
| 134 | YSFSEVSYWLVK | 23.8 | 754.38 | 795.44 | 38.7 | 2000 |
| 135 | YSFSEVSYWLVK | 23.8 | 754.38 | 894.51 | 38.7 | 2000 |
| 136 | YSFSEVSYWLVK | 23.8 | 754.38 | 1110.58 | 38.7 | 2000 |
| 137 | YSFSGVSYWLVK | 23.4 | 718.37 | 795.44 | 36.7 | 2000 |
| 138 | YSFSGVSYWLVK | 23.4 | 718.37 | 951.53 | 36.7 | 2000 |
| 139 | YSFSGVSYWLVK | 23.4 | 718.37 | 1185.63 | 36.7 | 2000 |

The other machine parameters used are as follows:

| | |
|---|---|
| Scan type: | MRM |
| MRM planned: | yes |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 50.00 psi |
| Cone voltage: | 5500.00 V |
| Source temperature: | 500.00° C. |
| Nebulising gas: | 50.00 psi |
| Heating gas: | 50.00 psi |
| Collision gas which induces dissociation: | 9.00 psi |
| Dynamic filling: | activated |
| Declustering potential (DP): | 100.00 V |
| Entry potential before Q0 (EP): | 6.00 V |
| Collision cell exit potential (CXP): | 15 V |
| Total cycle time: | 1 sec |
| Detection window: | 120 sec |

The areas obtained for each of the transitions and for each of the microorganisms studied were measured. When the areas of the transitions are greater than or equal to the positivity threshold described in TABLE 27, the detection of the transition is considered to be positive and is labelled "1" in TABLE 28. When a transition has an area less than the positivity threshold described in TABLE 27, the transition is considered non-detected and is labelled "0" in TABLE 28.

For a given peptide, when at least 3 transitions are labelled "1", the peptide is considered as being detected.

TABLE 28

| Transition number | Sam145 | Sam146 | Sam147 | Sam148 | Sam149 | Sam150 | Sam151 | Sam152 | Sam153 | Sam154 |
|---|---|---|---|---|---|---|---|---|---|---|
| 1 | 0 | 0 | 1 | 0 | 0 | 0 | 0 | 0 | 0 | 0 |
| 2 | 0 | 0 | 1 | 0 | 0 | 0 | 0 | 0 | 0 | 0 |
| 3 | 0 | 0 | 0 | 0 | 0 | 0 | 0 | 0 | 0 | 0 |
| 4 | 0 | 0 | 0 | 0 | 0 | 0 | 0 | 0 | 1 | 0 |
| 5 | 0 | 0 | 0 | 0 | 0 | 0 | 0 | 0 | 1 | 0 |
| 6 | 0 | 0 | 0 | 0 | 0 | 0 | 0 | 0 | 1 | 0 |
| 7 | 0 | 0 | 0 | 0 | 0 | 0 | 0 | 0 | 0 | 0 |
| 8 | 0 | 0 | 0 | 0 | 0 | 0 | 0 | 0 | 0 | 0 |
| 9 | 0 | 0 | 0 | 0 | 0 | 0 | 0 | 0 | 0 | 0 |
| 10 | 1 | 1 | 0 | 0 | 0 | 0 | 0 | 0 | 0 | 0 |
| 11 | 1 | 1 | 0 | 0 | 0 | 0 | 0 | 0 | 0 | 0 |
| 12 | 0 | 0 | 0 | 0 | 0 | 0 | 0 | 0 | 0 | 0 |
| 13 | 0 | 0 | 0 | 0 | 0 | 0 | 0 | 0 | 0 | 0 |
| 14 | 0 | 0 | 0 | 0 | 0 | 0 | 0 | 0 | 0 | 0 |
| 15 | 0 | 0 | 0 | 0 | 0 | 0 | 0 | 0 | 0 | 0 |
| 16 | 0 | 0 | 0 | 0 | 0 | 0 | 0 | 0 | 0 | 0 |
| 17 | 0 | 0 | 0 | 0 | 0 | 1 | 1 | 0 | 1 | 0 |
| 18 | 0 | 0 | 0 | 0 | 0 | 0 | 0 | 0 | 0 | 0 |
| 19 | 0 | 1 | 0 | 0 | 0 | 0 | 0 | 0 | 0 | 0 |
| 20 | 0 | 0 | 0 | 0 | 0 | 1 | 0 | 1 | 1 | 0 |
| 21 | 0 | 0 | 0 | 0 | 0 | 0 | 0 | 1 | 0 | 0 |
| 22 | 0 | 0 | 0 | 0 | 1 | 0 | 0 | 0 | 0 | 0 |
| 23 | 0 | 0 | 1 | 1 | 1 | 0 | 0 | 0 | 1 | 0 |
| 24 | 0 | 0 | 0 | 0 | 0 | 0 | 0 | 0 | 0 | 0 |
| 25 | 0 | 0 | 0 | 0 | 0 | 0 | 0 | 0 | 0 | 0 |
| 26 | 0 | 0 | 0 | 0 | 0 | 0 | 0 | 0 | 0 | 0 |
| 27 | 0 | 0 | 0 | 0 | 0 | 0 | 0 | 0 | 0 | 0 |
| 28 | 0 | 0 | 0 | 0 | 0 | 0 | 0 | 0 | 0 | 0 |
| 29 | 0 | 0 | 0 | 0 | 0 | 0 | 0 | 0 | 0 | 0 |
| 30 | 0 | 0 | 0 | 0 | 0 | 0 | 0 | 0 | 0 | 0 |
| 31 | 0 | 0 | 0 | 0 | 0 | 0 | 0 | 0 | 0 | 0 |
| 32 | 0 | 0 | 0 | 0 | 0 | 0 | 0 | 0 | 0 | 0 |
| 33 | 1 | 0 | 0 | 0 | 0 | 0 | 0 | 0 | 0 | 0 |
| 34 | 0 | 0 | 0 | 0 | 0 | 0 | 0 | 0 | 0 | 0 |
| 35 | 0 | 0 | 0 | 0 | 0 | 0 | 0 | 0 | 0 | 0 |
| 36 | 0 | 0 | 0 | 0 | 0 | 0 | 0 | 0 | 0 | 0 |
| 37 | 0 | 0 | 0 | 0 | 0 | 0 | 0 | 0 | 0 | 0 |
| 38 | 0 | 1 | 1 | 1 | 0 | 0 | 0 | 1 | 0 | 0 |
| 39 | 0 | 1 | 1 | 1 | 0 | 0 | 0 | 1 | 0 | 0 |
| 40 | 0 | 1 | 1 | 1 | 0 | 0 | 0 | 1 | 0 | 0 |
| 41 | 0 | 0 | 0 | 1 | 0 | 0 | 0 | 0 | 0 | 1 |
| 42 | 0 | 0 | 0 | 0 | 0 | 0 | 0 | 0 | 0 | 1 |
| 43 | 0 | 0 | 0 | 0 | 0 | 0 | 0 | 0 | 0 | 1 |
| 44 | 0 | 0 | 0 | 0 | 0 | 0 | 0 | 0 | 0 | 0 |
| 45 | 0 | 0 | 0 | 0 | 0 | 0 | 0 | 0 | 0 | 0 |
| 46 | 0 | 0 | 0 | 0 | 0 | 0 | 0 | 0 | 0 | 0 |
| 47 | 0 | 0 | 0 | 0 | 0 | 0 | 0 | 0 | 0 | 0 |
| 48 | 0 | 0 | 0 | 0 | 0 | 0 | 0 | 0 | 0 | 1 |
| 49 | 0 | 0 | 0 | 0 | 0 | 0 | 0 | 0 | 0 | 0 |
| 50 | 0 | 0 | 0 | 0 | 0 | 0 | 0 | 0 | 0 | 0 |
| 51 | 0 | 0 | 0 | 0 | 0 | 0 | 0 | 0 | 0 | 0 |
| 52 | 0 | 0 | 0 | 0 | 0 | 1 | 0 | 0 | 0 | 0 |
| 53 | 1 | 0 | 0 | 0 | 1 | 1 | 0 | 0 | 1 | 0 |
| 54 | 1 | 0 | 1 | 0 | 0 | 1 | 0 | 0 | 1 | 0 |
| 55 | 1 | 1 | 1 | 0 | 1 | 1 | 0 | 0 | 1 | 0 |

TABLE 28-continued

| Transition number | Sam145 | Sam146 | Sam147 | Sam148 | Sam149 | Sam150 | Sam151 | Sam152 | Sam153 | Sam154 |
|---|---|---|---|---|---|---|---|---|---|---|
| 56 | 0 | 1 | 1 | 1 | 1 | 0 | 1 | 1 | 0 | 0 |
| 57 | 0 | 1 | 1 | 1 | 1 | 0 | 1 | 1 | 0 | 0 |
| 58 | 0 | 1 | 1 | 1 | 1 | 0 | 1 | 1 | 0 | 0 |
| 59 | 0 | 0 | 0 | 0 | 0 | 1 | 1 | 0 | 0 | 0 |
| 60 | 0 | 0 | 0 | 0 | 0 | 1 | 1 | 0 | 0 | 0 |
| 61 | 0 | 0 | 0 | 0 | 0 | 1 | 1 | 0 | 0 | 0 |
| 62 | 0 | 0 | 0 | 1 | 0 | 0 | 1 | 1 | 0 | 0 |
| 63 | 0 | 0 | 0 | 1 | 0 | 0 | 1 | 1 | 0 | 0 |
| 64 | 0 | 0 | 0 | 1 | 0 | 0 | 1 | 1 | 0 | 0 |
| 65 | 0 | 0 | 0 | 0 | 0 | 1 | 1 | 1 | 1 | 0 |
| 66 | 0 | 0 | 0 | 0 | 0 | 0 | 0 | 0 | 0 | 0 |
| 67 | 0 | 0 | 0 | 0 | 0 | 0 | 0 | 0 | 0 | 0 |
| 68 | 0 | 0 | 0 | 0 | 0 | 0 | 0 | 0 | 0 | 0 |
| 69 | 0 | 0 | 0 | 0 | 0 | 0 | 0 | 0 | 0 | 0 |
| 70 | 0 | 1 | 0 | 0 | 0 | 0 | 0 | 0 | 0 | 0 |
| 71 | 1 | 1 | 1 | 0 | 0 | 0 | 0 | 0 | 0 | 0 |
| 72 | 0 | 1 | 1 | 0 | 0 | 0 | 0 | 0 | 0 | 0 |
| 73 | 0 | 1 | 1 | 0 | 0 | 0 | 0 | 0 | 0 | 0 |
| 74 | 0 | 0 | 0 | 1 | 0 | 0 | 1 | 1 | 0 | 0 |
| 75 | 0 | 0 | 0 | 1 | 0 | 0 | 1 | 1 | 0 | 0 |
| 76 | 0 | 0 | 0 | 1 | 0 | 0 | 1 | 1 | 0 | 0 |
| 77 | 0 | 0 | 0 | 0 | 0 | 0 | 0 | 0 | 0 | 1 |
| 78 | 0 | 0 | 0 | 0 | 0 | 0 | 0 | 0 | 0 | 1 |
| 79 | 0 | 1 | 1 | 0 | 0 | 0 | 0 | 0 | 0 | 1 |
| 80 | 0 | 0 | 0 | 0 | 0 | 0 | 0 | 0 | 0 | 0 |
| 81 | 0 | 0 | 0 | 0 | 0 | 0 | 0 | 0 | 0 | 0 |
| 82 | 0 | 1 | 0 | 0 | 0 | 0 | 0 | 0 | 0 | 0 |
| 83 | 1 | 0 | 0 | 0 | 1 | 1 | 0 | 0 | 0 | 1 |
| 84 | 1 | 0 | 0 | 0 | 1 | 1 | 0 | 0 | 1 | 0 |
| 85 | 1 | 0 | 1 | 1 | 1 | 1 | 1 | 1 | 1 | 0 |
| 86 | 0 | 0 | 1 | 0 | 0 | 0 | 0 | 0 | 0 | 0 |
| 87 | 0 | 0 | 1 | 0 | 0 | 0 | 0 | 0 | 0 | 0 |
| 88 | 0 | 0 | 0 | 0 | 0 | 0 | 0 | 0 | 0 | 0 |
| 89 | 0 | 0 | 0 | 0 | 0 | 0 | 0 | 0 | 0 | 0 |
| 90 | 0 | 0 | 0 | 0 | 0 | 0 | 0 | 0 | 1 | 0 |
| 91 | 0 | 0 | 0 | 0 | 0 | 0 | 0 | 0 | 1 | 0 |
| 92 | 1 | 0 | 0 | 0 | 0 | 0 | 0 | 0 | 0 | 0 |
| 93 | 0 | 0 | 0 | 0 | 0 | 0 | 0 | 0 | 0 | 0 |
| 94 | 0 | 0 | 0 | 0 | 0 | 0 | 0 | 0 | 0 | 0 |
| 95 | 0 | 1 | 0 | 0 | 0 | 0 | 0 | 0 | 0 | 0 |
| 96 | 0 | 0 | 0 | 0 | 0 | 0 | 0 | 0 | 0 | 0 |
| 97 | 0 | 0 | 0 | 0 | 0 | 0 | 0 | 0 | 0 | 0 |
| 98 | 0 | 1 | 1 | 0 | 0 | 0 | 0 | 0 | 0 | 0 |
| 99 | 0 | 1 | 1 | 0 | 0 | 0 | 0 | 0 | 0 | 0 |
| 100 | 0 | 1 | 1 | 1 | 0 | 0 | 0 | 0 | 0 | 0 |
| 101 | 0 | 0 | 0 | 0 | 0 | 0 | 0 | 0 | 0 | 0 |
| 102 | 0 | 0 | 0 | 0 | 0 | 0 | 0 | 0 | 0 | 0 |
| 103 | 0 | 0 | 0 | 0 | 0 | 0 | 1 | 1 | 0 | 0 |
| 104 | 0 | 0 | 0 | 1 | 0 | 0 | 0 | 0 | 0 | 0 |
| 105 | 0 | 0 | 0 | 1 | 1 | 0 | 0 | 0 | 0 | 0 |
| 106 | 0 | 0 | 0 | 0 | 0 | 0 | 0 | 0 | 0 | 0 |
| 107 | 0 | 0 | 0 | 0 | 0 | 0 | 0 | 0 | 0 | 0 |
| 108 | 0 | 0 | 0 | 0 | 0 | 0 | 0 | 0 | 0 | 0 |
| 109 | 0 | 0 | 0 | 0 | 0 | 0 | 0 | 0 | 0 | 0 |
| 110 | 1 | 1 | 0 | 0 | 0 | 0 | 0 | 0 | 0 | 0 |
| 111 | 1 | 1 | 0 | 0 | 0 | 0 | 0 | 0 | 1 | 0 |
| 112 | 1 | 0 | 0 | 0 | 0 | 0 | 0 | 0 | 0 | 0 |
| 113 | 0 | 0 | 0 | 1 | 0 | 0 | 0 | 0 | 0 | 0 |
| 114 | 0 | 0 | 0 | 1 | 0 | 0 | 0 | 1 | 0 | 0 |
| 115 | 0 | 0 | 0 | 1 | 0 | 0 | 0 | 0 | 0 | 0 |
| 116 | 0 | 1 | 0 | 1 | 0 | 0 | 1 | 0 | 0 | 0 |
| 117 | 0 | 1 | 1 | 1 | 0 | 0 | 1 | 0 | 0 | 0 |
| 118 | 0 | 1 | 0 | 1 | 0 | 0 | 1 | 0 | 0 | 0 |
| 119 | 0 | 0 | 0 | 0 | 0 | 0 | 0 | 0 | 1 | 0 |
| 120 | 0 | 0 | 0 | 0 | 0 | 0 | 0 | 0 | 1 | 0 |
| 121 | 0 | 0 | 0 | 0 | 0 | 0 | 0 | 0 | 1 | 0 |
| 122 | 1 | 0 | 0 | 0 | 1 | 1 | 0 | 0 | 0 | 0 |
| 123 | 1 | 0 | 0 | 0 | 1 | 1 | 0 | 0 | 0 | 0 |
| 124 | 1 | 0 | 0 | 0 | 1 | 1 | 0 | 0 | 0 | 0 |
| 125 | 0 | 0 | 0 | 0 | 0 | 0 | 0 | 0 | 0 | 0 |
| 126 | 0 | 0 | 0 | 0 | 0 | 0 | 0 | 1 | 0 | 0 |
| 127 | 0 | 0 | 0 | 1 | 1 | 0 | 0 | 0 | 0 | 0 |
| 128 | 0 | 0 | 0 | 0 | 0 | 0 | 0 | 0 | 0 | 1 |
| 129 | 0 | 0 | 0 | 0 | 0 | 0 | 0 | 0 | 0 | 0 |
| 130 | 0 | 0 | 0 | 0 | 0 | 0 | 0 | 0 | 0 | 0 |
| 131 | 0 | 0 | 0 | 0 | 0 | 0 | 0 | 0 | 0 | 0 |
| 132 | 0 | 0 | 0 | 0 | 0 | 0 | 0 | 0 | 0 | 0 |

TABLE 28-continued

| Transition number | Sam145 | Sam146 | Sam147 | Sam148 | Sam149 | Sam150 | Sam151 | Sam152 | Sam153 | Sam154 |
|---|---|---|---|---|---|---|---|---|---|---|
| 133 | 0 | 0 | 0 | 0 | 0 | 0 | 0 | 0 | 0 | 0 |
| 134 | 0 | 0 | 0 | 0 | 0 | 0 | 0 | 0 | 0 | 0 |
| 135 | 0 | 0 | 0 | 0 | 0 | 0 | 1 | 0 | 0 | 0 |
| 136 | 0 | 0 | 0 | 0 | 0 | 0 | 0 | 0 | 0 | 0 |
| 137 | 1 | 0 | 0 | 0 | 0 | 0 | 0 | 0 | 0 | 0 |
| 138 | 0 | 0 | 0 | 0 | 0 | 0 | 0 | 0 | 0 | 0 |
| 139 | 0 | 0 | 0 | 0 | 0 | 0 | 0 | 0 | 0 | 0 |

Samples Sam145 to Sam154 comprise at least one peptide which is characteristic of IMPs. The bacteria present in samples Sam145 to Sam154 therefore express a beta-lactamase which confers on them a resistance to penicillins, to cephalosporins and to carbapenems.

EXAMPLE 18

Identification of a Resistance to OXA-48 Beta-Lactams

Samples Sam155 to Sam164 are identified according to one of the methods described in examples 1, 3 or 4. The identification of the species is set out in TABLE 29.

TABLE 29

| Names | Species |
|---|---|
| Sam155 | K. pneumoniae |
| Sam156 | K. pneumoniae |

TABLE 29-continued

| Names | Species |
|---|---|
| Sam157 | K. pneumoniae |
| Sam158 | E. cloacae |
| Sam159 | E. cloacae |
| Sam160 | K. pneumoniae |
| Sam161 | K. pneumoniae |
| Sam162 | K. pneumoniae |
| Sam163 | K. pneumoniae |
| Sam164 | K. pneumoniae |

Samples Sam155 to Sam164 correspond to a species able to comprise an OXA-48 resistance mechanism. The following method is then performed to detect such a mechanism.

Each sample is treated according to Example 5, then analysed according to Example 6 unless otherwise stated in the rest of the example, by detecting the peptides from TABLE 30 instead of the peptides from TABLE 3.

TABLE 30

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 1 | ANQAFLPASTFK | 2 | y6 monocharged | 18.09 | 647.84 | 650.35 | 32.7 | 2000 |
| 2 | ANQAFLPASTFK | 2 | y7 monocharged | 18.11 | 647.84 | 763.44 | 32.7 | 2000 |
| 3 | ANQAFLPASTFK | 2 | y8 monocharged | 18.09 | 647.84 | 910.5 | 32.7 | 2000 |
| 4 | DEHQVFK | 3 | y5 dicharged | 9.89 | 301.48 | 329.69 | 16.4 | 2000 |
| 5 | DEHQVFK | 2 | y4 monocharged | 9.89 | 451.72 | 521.31 | 21.5 | 2000 |
| 6 | DEHQVFK | 2 | y5 monocharged | 9.91 | 451.72 | 658.37 | 21.5 | 2000 |
| 7 | DHNLITAMK | 3 | y3 monocharged | 14.57 | 348.18 | 349.19 | 17.9 | 2000 |
| 8 | DHNLITAMK | 3 | y4 monocharged | 14.57 | 348.18 | 450.24 | 17.9 | 2000 |
| 9 | DHNLITAMK | 2 | y7 monocharged | 14.57 | 521.77 | 790.45 | 25.5 | 2000 |
| 10 | DIATWNR | 2 | y3 monocharged | 13.79 | 438.22 | 475.24 | 20.7 | 2000 |
| 11 | DIATWNR | 2 | y4 monocharged | 13.79 | 438.22 | 576.29 | 20.7 | 2000 |
| 12 | DIATWNR | 2 | y5 monocharged | 13.79 | 438.22 | 647.33 | 20.7 | 2000 |
| 13 | IPNSLIALDLGVVK | 3 | y6 monocharged | 23.68 | 484.63 | 630.38 | 22.1 | 2000 |
| 14 | IPNSLIALDLGVVK | 2 | y13 dicharged | 23.68 | 726.45 | 669.9 | 37.1 | 2000 |
| 15 | IPNSLIALDLGVVK | 2 | y8 monocharged | 23.68 | 726.45 | 814.5 | 37.1 | 2000 |
| 16 | ISATEQISFLR | 2 | y4 monocharged | 19.17 | 632.85 | 522.3 | 31.8 | 2000 |
| 17 | ISATEQISFLR | 2 | y5 monocharged | 19.17 | 632.85 | 635.39 | 31.8 | 2000 |
| 18 | ISATEQISFLR | 2 | y6 monocharged | 19.17 | 632.85 | 763.45 | 31.8 | 2000 |

TABLE 30-continued

| Transition number | Peptide | Charge state of the precursor | Fragment ion | Retention time (minutes) | (m/z) filtered in Q1 | (m/z) filtered in Q3 | Collision energy (eV) | Positivity threshold |
|---|---|---|---|---|---|---|---|---|
| 19 | QAMLTEANGDYIIR | 3 | y4 monocharged | 18.36 | 532.27 | 564.35 | 23.6 | 2000 |
| 20 | QAMLTEANGDYIIR | 3 | y6 monocharged | 18.36 | 532.27 | 736.4 | 23.6 | 2000 |
| 21 | QAMLTEANGDYIIR | 2 | y10 monocharged | 18.36 | 797.9 | 1151.57 | 41.2 | 2000 |
| 22 | QQGFTNNLK | 2 | y4 monocharged | 12.58 | 525.27 | 488.28 | 25.7 | 2000 |
| 23 | QQGFTNNLK | 2 | y5 monocharged | 12.58 | 525.27 | 589.33 | 25.7 | 2000 |
| 24 | QQGFTNNLK | 2 | y7 monocharged | 12.58 | 525.27 | 793.42 | 25.7 | 2000 |
| 25 | SQGVVVLWNENK | 2 | y5 monocharged | 18.54 | 686.87 | 690.32 | 34.9 | 2000 |
| 26 | SQGVVVLWNENK | 2 | y6 monocharged | 18.54 | 686.87 | 803.41 | 34.9 | 2000 |
| 27 | SQGVVVLWNENK | 2 | y7 monocharged | 18.52 | 686.87 | 902.47 | 34.9 | 2000 |
| 28 | SWNAHFTEHK | 3 | y8 dicharged | 12.23 | 419.53 | 492.24 | 20.1 | 2000 |
| 29 | SWNAHFTEHK | 3 | y9 dicharged | 12.23 | 419.53 | 585.28 | 20.1 | 2000 |
| 30 | SWNAHFTEHK | 3 | y5 monocharged | 12.23 | 419.53 | 661.33 | 20.1 | 2000 |
| 31 | VLALSAVFLVASIIGMPAVAK | 3 | y6 monocharged | 34.92 | 690.75 | 616.35 | 28.5 | 2000 |
| 32 | VLALSAVFLVASIIGMPAVAK | 3 | y7 monocharged | 34.94 | 690.75 | 673.37 | 28.5 | 2000 |
| 33 | VLALSAVFLVASIIGMPAVAK | 3 | y8 monocharged | 34.94 | 690.75 | 786.45 | 28.5 | 2000 |
| 34 | YSVVPVYQEFAR | 3 | y5 monocharged | 20.05 | 486.59 | 650.33 | 22.2 | 2000 |
| 35 | YSVVPVYQEFAR | 2 | y8 dicharged | 20.07 | 729.38 | 505.26 | 37.3 | 2000 |
| 36 | YSVVPVYQEFAR | 2 | y8 monocharged | 20.07 | 729.38 | 1009.51 | 37.3 | 2000 |

The other machine parameters used are as follows:

| | |
|---|---|
| Scan type: | MRM |
| MRM planned: | no |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 40.00 psi |
| Cone voltage: | 5500.00 V |
| Source temperature: | 500.00° C. |
| Nebulising gas: | 50.00 psi |
| Heating gas: | 50.00 psi |
| Collision gas which induces dissociation: | 9.00 psi |
| Dynamic filling: | activated |
| Declustering potential (DP): | 100.00 V |
| Entry potential before Q0 (EP): | 6.00 V |
| Collision cell exit potential (CXP): | 15 V |
| Total cycle time: | 1.1 sec |

The areas obtained for each of the transitions and for each of the microorganisms studied were measured. When the areas of the transitions are greater than or equal to the positivity threshold described in TABLE 30, the detection of the transition is considered to be positive and is labelled "1" in TABLE 31. When a transition has an area less than the positivity threshold described in TABLE 30, the transition is considered non-detected and is labelled "0" in TABLE 31.

For a given peptide, when at least 3 transitions are labelled "1", the peptide is considered as being detected.

TABLE 31

| Transition number | Sam155 | Sam156 | Sam157 | Sam158 | Sam159 | Sam160 | Sam161 | Sam162 | Sam163 | Sam164 |
|---|---|---|---|---|---|---|---|---|---|---|
| 1 | 0 | 1 | 1 | 0 | 1 | 1 | 1 | 1 | 1 | 0 |
| 2 | 0 | 1 | 1 | 0 | 1 | 1 | 1 | 0 | 1 | 0 |
| 3 | 0 | 1 | 0 | 0 | 0 | 1 | 1 | 0 | 0 | 0 |
| 4 | 0 | 0 | 0 | 0 | 0 | 0 | 0 | 0 | 0 | 0 |
| 5 | 0 | 0 | 0 | 0 | 0 | 0 | 0 | 0 | 0 | 0 |
| 6 | 0 | 0 | 0 | 0 | 0 | 0 | 0 | 0 | 0 | 0 |
| 7 | 0 | 1 | 0 | 0 | 0 | 1 | 1 | 0 | 0 | 0 |
| 8 | 0 | 1 | 1 | 1 | 0 | 1 | 1 | 0 | 1 | 0 |
| 9 | 1 | 1 | 1 | 1 | 1 | 1 | 1 | 1 | 1 | 0 |

TABLE 31-continued

| Transition number | Sam155 | Sam156 | Sam157 | Sam158 | Sam159 | Sam160 | Sam161 | Sam162 | Sam163 | Sam164 |
|---|---|---|---|---|---|---|---|---|---|---|
| 10 | 0 | 0 | 0 | 0 | 0 | 0 | 0 | 0 | 0 | 0 |
| 11 | 0 | 0 | 0 | 1 | 1 | 0 | 0 | 0 | 0 | 0 |
| 12 | 0 | 0 | 0 | 0 | 0 | 0 | 0 | 1 | 0 | 0 |
| 13 | 0 | 1 | 1 | 1 | 1 | 1 | 1 | 1 | 1 | 0 |
| 14 | 0 | 1 | 1 | 1 | 1 | 1 | 1 | 1 | 1 | 1 |
| 15 | 0 | 1 | 1 | 1 | 1 | 1 | 1 | 1 | 1 | 0 |
| 16 | 1 | 1 | 1 | 1 | 1 | 1 | 1 | 1 | 1 | 1 |
| 17 | 1 | 1 | 1 | 1 | 1 | 1 | 1 | 1 | 1 | 1 |
| 18 | 1 | 1 | 1 | 1 | 1 | 1 | 1 | 1 | 1 | 1 |
| 19 | 1 | 1 | 1 | 1 | 1 | 1 | 1 | 1 | 1 | 1 |
| 20 | 1 | 1 | 1 | 1 | 1 | 1 | 1 | 1 | 1 | 0 |
| 21 | 1 | 1 | 1 | 1 | 1 | 1 | 1 | 1 | 1 | 1 |
| 22 | 1 | 1 | 1 | 1 | 1 | 1 | 1 | 1 | 1 | 0 |
| 23 | 1 | 1 | 1 | 1 | 1 | 1 | 1 | 1 | 1 | 1 |
| 24 | 1 | 1 | 1 | 1 | 1 | 1 | 1 | 1 | 1 | 0 |
| 25 | 0 | 0 | 0 | 0 | 0 | 0 | 0 | 0 | 0 | 0 |
| 26 | 0 | 0 | 0 | 0 | 0 | 0 | 0 | 0 | 0 | 0 |
| 27 | 0 | 0 | 0 | 0 | 0 | 0 | 0 | 0 | 0 | 0 |
| 28 | 1 | 1 | 1 | 1 | 1 | 1 | 1 | 1 | 1 | 1 |
| 29 | 1 | 1 | 1 | 1 | 1 | 1 | 1 | 1 | 1 | 1 |
| 30 | 1 | 1 | 1 | 1 | 1 | 1 | 1 | 1 | 1 | 0 |
| 31 | 1 | 0 | 0 | 0 | 1 | 0 | 0 | 0 | 0 | 0 |
| 32 | 1 | 1 | 1 | 1 | 1 | 1 | 1 | 1 | 1 | 0 |
| 33 | 1 | 1 | 0 | 1 | 1 | 1 | 1 | 1 | 1 | 0 |
| 34 | 0 | 1 | 1 | 0 | 1 | 1 | 1 | 0 | 1 | 0 |
| 35 | 0 | 1 | 1 | 0 | 1 | 1 | 1 | 0 | 1 | 0 |
| 36 | 0 | 1 | 1 | 0 | 1 | 1 | 1 | 0 | 1 | 0 |

Samples Sam155 to Sam164 comprise at least one peptide which is characteristic of the OXA-48 group. The bacteria present in samples Sam155 to Sam164 therefore express a beta-lactamase which confers on them a resistance to penicillins, to first-generation and second-generation cephalosporins (but not to broad-spectrum cephalosporins), and to carbapenems.

EXAMPLE 19

Identification of a Resistance to VIM Beta-Lactams

Samples Sam165 to Sam170 are identified according to one of the methods described in examples 1, 3 or 4. The identification of the species is set out in TABLE 32.

TABLE 32

| Names | Species |
|---|---|
| Sam165 | *P. aeruginosa* |
| Sam166 | *E. coli* |
| Sam167 | *A. baumannii* complex |
| Sam168 | *A. junii* |
| Sam169 | *E. coli* |
| Sam170 | *K. pneumoniae* ssp *pneumoniae* |

Samples Sam165 to Sam170 correspond to a species able to comprise a VIM resistance mechanism. The following method is then performed to detect such a mechanism.

Each sample is treated according to Example 5, then analysed according to Example 6 unless otherwise stated in the rest of the example, by detecting the peptides from TABLE 33 instead of the peptides from TABLE 3.

TABLE 33

| Transition number | Peptide | Retention time (minutes) | (m/z) filtered in Q1 | (m/z) filtered in Q3 | Collision energy (eV) | Positivity threshold |
|---|---|---|---|---|---|---|
| 1 | AAGVATYASPSAR | 12.3 | 611.32 | 588.31 | 30.6 | 2500 |
| 2 | AAGVATYASPSAR | 12.3 | 611.32 | 852.42 | 30.6 | 2500 |
| 3 | AAGVATYASPSAR | 12.3 | 611.32 | 923.46 | 30.6 | 2500 |
| 4 | AAGVATYASPSIR | 14.5 | 632.34 | 630.36 | 31.8 | 2500 |
| 5 | AAGVATYASPSIR | 14.5 | 632.34 | 894.47 | 31.8 | 2500 |
| 6 | AAGVATYASPSIR | 14.5 | 632.34 | 965.51 | 31.8 | 2500 |
| 7 | AAGVATYASPSTR | 12 | 626.32 | 618.32 | 31.4 | 2500 |
| 8 | AAGVATYASPSTR | 12 | 626.32 | 882.43 | 31.4 | 2500 |
| 9 | AAGVATYASPSTR | 12 | 626.32 | 953.47 | 31.4 | 2500 |
| 10 | AAGVATYTSPLTR | 15.7 | 654.35 | 674.38 | 33 | 2500 |

TABLE 33-continued

| Transition number | Peptide | Retention time (minutes) | (m/z) filtered in Q1 | (m/z) filtered in Q3 | Collision energy (eV) | Positivity threshold |
|---|---|---|---|---|---|---|
| 11 | AAGVATYTSPLTR | 15.7 | 654.35 | 938.49 | 33 | 2500 |
| 12 | AAGVATYTSPLTR | 15.7 | 654.35 | 1009.53 | 33 | 2500 |
| 13 | AGVATYASPSTR | 11.8 | 590.8 | 547.28 | 29.4 | 2500 |
| 14 | AGVATYASPSTR | 11.8 | 590.8 | 618.32 | 29.4 | 2500 |
| 15 | AGVATYASPSTR | 11.8 | 590.8 | 781.38 | 29.4 | 2500 |
| 16 | ALSSSGDVVR | 11.3 | 495.76 | 632.34 | 24 | 2500 |
| 17 | ALSSSGDVVR | 11.3 | 495.76 | 719.37 | 24 | 2500 |
| 18 | ALSSSGDVVR | 11.3 | 495.76 | 806.4 | 24 | 2500 |
| 19 | AVSTHFHDDR | 9.2 | 395.52 | 413.68 | 19.3 | 2500 |
| 20 | AVSTHFHDDR | 9.2 | 395.52 | 507.72 | 19.3 | 2500 |
| 21 | AVSTHFHDDR | 9.2 | 395.52 | 689.3 | 19.3 | 2500 |
| 22 | DADELLLIDTAWGAK | 24.3 | 544.28 | 748.36 | 24 | 2500 |
| 23 | DADELLLIDTAWGAK | 24.3 | 815.92 | 544.31 | 42.2 | 2500 |
| 24 | DADELLLIDTAWGAK | 24.3 | 815.92 | 748.36 | 42.2 | 2500 |
| 25 | DADELLLIDTAWGAK | 24.3 | 815.92 | 861.45 | 42.2 | 2500 |
| 26 | DGDELLLIDTAWGAK | 24 | 539.61 | 748.36 | 23.8 | 2500 |
| 27 | DGDELLLIDTAWGAK | 24 | 808.91 | 748.36 | 41.8 | 2500 |
| 28 | DGDELLLIDTAWGAK | 24 | 808.91 | 861.45 | 41.8 | 2500 |
| 29 | DGDELLLIDTAWGTK | 24.1 | 549.61 | 778.37 | 24.1 | 2500 |
| 30 | DGDELLLIDTAWGTK | 24.1 | 823.92 | 778.37 | 42.7 | 2500 |
| 31 | DGDELLLIDTAWGTK | 24.1 | 823.92 | 891.46 | 42.7 | 2500 |
| 32 | ESAGNVADANLAEWPATIK | 20.2 | 652.99 | 529.33 | 27.3 | 2500 |
| 33 | ESAGNVADANLAEWPATIK | 20.2 | 652.99 | 715.41 | 27.3 | 2500 |
| 34 | ESAGNVADANLAEWPATIK | 20.2 | 978.99 | 529.33 | 51.5 | 2500 |
| 35 | GEYPTVSEIPVGEVR | 18.4 | 544.61 | 656.37 | 24 | 2500 |
| 36 | GEYPTVSEIPVGEVR | 18.4 | 816.42 | 641.85 | 42.3 | 2500 |
| 37 | GEYPTVSEIPVGEVR | 18.4 | 816.42 | 656.37 | 42.3 | 2500 |
| 38 | HTTNVVK | 1.3 | 399.73 | 345.25 | 18.5 | 2500 |
| 39 | HTTNVVK | 1.3 | 399.73 | 560.34 | 18.5 | 2500 |
| 40 | HTTNVVK | 1.3 | 399.73 | 661.39 | 18.5 | 2500 |
| 41 | IGDGVWSHIATQK | 17 | 471.25 | 563.8 | 21.7 | 2500 |
| 42 | IGDGVWSHIATQK | 17 | 471.25 | 621.32 | 21.7 | 2500 |
| 43 | IGDGVWSHIATQK | 17 | 471.25 | 649.83 | 21.7 | 2500 |
| 44 | LGDTVYSSNGLIVR | 17.9 | 747.4 | 387.27 | 38.3 | 2500 |
| 45 | LGDTVYSSNGLIVR | 17.9 | 747.4 | 845.48 | 38.3 | 2500 |
| 46 | LGDTVYSSNGLIVR | 17.9 | 747.4 | 1008.55 | 38.3 | 2500 |
| 47 | LYQIADGVWSHIATK | 20.8 | 567.97 | 592.81 | 24.7 | 2500 |
| 48 | LYQIADGVWSHIATK | 20.8 | 567.97 | 649.35 | 24.7 | 2500 |

TABLE 33-continued

| Transition number | Peptide | Retention time (minutes) | (m/z) filtered in Q1 | (m/z) filtered in Q3 | Collision energy (eV) | Positivity threshold |
|---|---|---|---|---|---|---|
| 49 | LYQIADGVWSHIATK | 20.8 | 567.97 | 713.38 | 24.7 | 2500 |
| 50 | LYQIADGVWSHIATR | 21 | 577.31 | 606.81 | 25 | 2500 |
| 51 | LYQIADGVWSHIATR | 21 | 577.31 | 663.35 | 25 | 2500 |
| 52 | LYQIADGVWSHIATR | 21 | 577.31 | 727.38 | 25 | 2500 |
| 53 | NTAALLAEIEK | 19.8 | 586.83 | 589.32 | 29.2 | 2500 |
| 54 | NTAALLAEIEK | 19.8 | 586.83 | 702.4 | 29.2 | 2500 |
| 55 | NTAALLAEIEK | 19.8 | 586.83 | 886.52 | 29.2 | 2500 |
| 56 | NTVALLAEIEK | 21.2 | 600.85 | 589.32 | 30 | 2500 |
| 57 | NTVALLAEIEK | 21.2 | 600.85 | 702.4 | 30 | 2500 |
| 58 | NTVALLAEIEK | 21.2 | 600.85 | 886.52 | 30 | 2500 |
| 59 | QIGLPVTR | 15.6 | 442.27 | 472.29 | 20.9 | 2500 |
| 60 | QIGLPVTR | 15.6 | 442.27 | 642.39 | 20.9 | 2500 |
| 61 | QIGLPVTR | 15.6 | 442.27 | 755.48 | 20.9 | 2500 |
| 62 | QLAEAAGNEVPAHSLK | 13.8 | 545.62 | 597.32 | 24 | 2500 |
| 63 | QLAEAAGNEVPAHSLK | 13.8 | 545.62 | 652.38 | 24 | 2500 |
| 64 | QLAEAAGNEVPAHSLK | 13.8 | 545.62 | 697.36 | 24 | 2500 |
| 65 | SFDGAVYPSNGLIVR | 19.2 | 797.92 | 559.32 | 41.2 | 2500 |
| 66 | SFDGAVYPSNGLIVR | 19.2 | 797.92 | 855.51 | 41.2 | 2500 |
| 67 | SFDGAVYPSNGLIVR | 19.2 | 797.92 | 1018.57 | 41.2 | 2500 |
| 68 | SISTHFHDDR | 10.6 | 405.52 | 413.68 | 19.7 | 2500 |
| 69 | SISTHFHDDR | 10.6 | 405.52 | 507.72 | 19.7 | 2500 |
| 70 | SISTHFHDDR | 10.6 | 405.52 | 689.3 | 19.7 | 2500 |
| 71 | SVSTHFHDDR | 9.2 | 400.85 | 413.68 | 19.5 | 2500 |
| 72 | SVSTHFHDDR | 9.2 | 400.85 | 507.72 | 19.5 | 2500 |
| 73 | SVSTHFHDDR | 9.2 | 400.85 | 689.3 | 19.5 | 2500 |
| 74 | TSAGNVADADLAEWPGSVER | 19.2 | 682.32 | 322.67 | 28.2 | 2500 |
| 75 | TSAGNVADADLAEWPGSVER | 19.2 | 682.32 | 644.34 | 28.2 | 2500 |
| 76 | TSAGNVADADLAEWPGSVER | 19.2 | 682.32 | 830.42 | 28.2 | 2500 |
| 77 | TSAGNVADADLAEWPGSVER | 19.2 | 1022.98 | 644.34 | 54 | 2500 |
| 78 | TSAGNVADADLAEWPTSIER | 20.7 | 701.67 | 351.69 | 28.8 | 2500 |
| 79 | TSAGNVADADLAEWPTSIER | 20.7 | 701.67 | 702.38 | 28.8 | 2500 |
| 80 | TSAGNVADADLAEWPTSIER | 20.7 | 701.67 | 888.46 | 28.8 | 2500 |
| 81 | TSAGNVADADLAEWPTSIER | 20.7 | 1052 | 702.38 | 55.7 | 2500 |
| 82 | TSAGNVADADLAEWPTSVER | 19.6 | 697 | 344.69 | 28.7 | 2500 |
| 83 | TSAGNVADADLAEWPTSVER | 19.6 | 697 | 688.36 | 28.7 | 2500 |
| 84 | TSAGNVADADLAEWPTSVER | 19.6 | 697 | 874.44 | 28.7 | 2500 |
| 85 | TSAGNVADADLAEWPTSVER | 19.6 | 1045 | 688.36 | 55.3 | 2500 |
| 86 | VGGVDALR | 12.8 | 393.73 | 474.27 | 18.2 | 2500 |

TABLE 33-continued

| Transition number | Peptide | Retention time (minutes) | (m/z) filtered in Q1 | (m/z) filtered in Q3 | Collision energy (eV) | Positivity threshold |
|---|---|---|---|---|---|---|
| 87 | VGGVDALR | 12.8 | 393.73 | 630.36 | 18.2 | 2500 |
| 88 | VGGVDALR | 12.8 | 393.73 | 687.38 | 18.2 | 2500 |
| 89 | VGGVDVLR | 14.8 | 407.74 | 502.3 | 19 | 2500 |
| 90 | VGGVDVLR | 14.8 | 407.74 | 658.39 | 19 | 2500 |
| 91 | VGGVDVLR | 14.8 | 407.74 | 715.41 | 19 | 2500 |
| 92 | VLFGGCAVHEASR | 15.1 | 468.24 | 522.24 | 21.6 | 5100 |
| 93 | VLFGGCAVHEASR | 15.1 | 468.24 | 595.77 | 21.6 | 5100 |
| 94 | VLFGGCAVHEASR | 15.1 | 468.24 | 599.29 | 21.6 | 5100 |
| 95 | VLYGGCAVHELSR | 15.3 | 487.58 | 543.26 | 22.2 | 2500 |
| 96 | VLYGGCAVHELSR | 15.3 | 487.58 | 624.79 | 22.2 | 2500 |
| 97 | VLYGGCAVHELSR | 15.3 | 487.58 | 641.34 | 22.2 | 2500 |

The other machine parameters used are as follows:

| | |
|---|---|
| Scan type: | MRM |
| MRM planned: | yes |
| Polarity: | Positive |
| Ionising source: | Turbo V ™ (Applied BioSystems) |
| Q1 setting: | Filtering with unit resolution |
| Q3 setting: | Filtering with unit resolution |
| Inter-scan pause: | 5.00 msec |
| Scanning speed: | 10 Da/s |
| Curtain gas: | 50.00 psi |
| Cone voltage: | 5500.00 V |
| Source temperature: | 500.00° C. |
| Nebulising gas: | 50.00 psi |
| Heating gas: | 50.00 psi |
| Collision gas which induces dissociation: | 9.00 psi |
| Dynamic filling: | activated |
| Declustering potential (DP): | 100.00 V |
| Entry potential before Q0 (EP): | 6.00 V |
| Collision cell exit potential (CXP): | 15 V |
| Total cycle time: | 0.04 sec |
| Detection window: | 120 sec |

The areas obtained for each of the transitions and for each of the microorganisms studied were measured. When the areas of the transitions are greater than or equal to the positivity threshold described in TABLE 33, the detection of the transition is considered to be positive and is labelled "1" in TABLE 34. When a transition has an area less than the positivity threshold described in TABLE 33, the transition is considered non-detected and is labelled "0" in TABLE 34.

For a given peptide, when at least 3 transitions are labelled "1", the peptide is considered as being detected.

TABLE 34

| Transition number | Sam165 | Sam166 | Sam167 | Sam168 | Sam169 | Sam170 |
|---|---|---|---|---|---|---|
| 1 | 0 | 0 | 0 | 0 | 0 | 0 |
| 2 | 0 | 0 | 0 | 0 | 0 | 0 |
| 3 | 0 | 0 | 0 | 0 | 0 | 0 |
| 4 | 0 | 0 | 0 | 0 | 0 | 0 |
| 5 | 0 | 0 | 0 | 0 | 0 | 0 |
| 6 | 0 | 0 | 0 | 0 | 0 | 0 |
| 7 | 0 | 0 | 0 | 0 | 0 | 1 |
| 8 | 0 | 0 | 0 | 0 | 0 | 1 |
| 9 | 0 | 0 | 0 | 0 | 0 | 1 |
| 10 | 0 | 0 | 0 | 0 | 0 | 0 |
| 11 | 0 | 0 | 0 | 0 | 0 | 0 |
| 12 | 0 | 0 | 0 | 0 | 0 | 0 |
| 13 | 0 | 0 | 0 | 0 | 0 | 1 |
| 14 | 0 | 0 | 0 | 0 | 0 | 1 |
| 15 | 0 | 0 | 0 | 0 | 0 | 1 |
| 16 | 0 | 0 | 0 | 0 | 0 | 0 |
| 17 | 0 | 0 | 0 | 0 | 0 | 0 |
| 18 | 0 | 0 | 0 | 0 | 0 | 0 |
| 19 | 1 | 1 | 1 | 1 | 1 | 1 |
| 20 | 1 | 1 | 1 | 1 | 1 | 1 |
| 21 | 1 | 1 | 1 | 1 | 1 | 1 |
| 22 | 0 | 0 | 0 | 0 | 0 | 0 |
| 23 | 0 | 0 | 0 | 0 | 0 | 0 |
| 24 | 0 | 0 | 0 | 0 | 0 | 0 |
| 25 | 0 | 0 | 0 | 0 | 0 | 0 |
| 26 | 0 | 0 | 0 | 0 | 0 | 0 |
| 27 | 0 | 0 | 0 | 0 | 0 | 0 |
| 28 | 0 | 0 | 0 | 0 | 0 | 0 |
| 29 | 0 | 0 | 0 | 0 | 0 | 0 |
| 30 | 0 | 0 | 0 | 0 | 0 | 0 |
| 31 | 0 | 0 | 0 | 0 | 0 | 0 |
| 32 | 0 | 0 | 0 | 0 | 0 | 0 |
| 33 | 0 | 0 | 0 | 0 | 0 | 0 |
| 34 | 0 | 0 | 0 | 0 | 0 | 0 |
| 35 | 0 | 0 | 0 | 0 | 0 | 0 |
| 36 | 0 | 0 | 0 | 0 | 0 | 0 |
| 37 | 0 | 0 | 0 | 0 | 0 | 0 |
| 38 | 0 | 0 | 0 | 0 | 0 | 0 |
| 39 | 0 | 0 | 0 | 0 | 0 | 0 |
| 40 | 0 | 0 | 0 | 0 | 0 | 0 |
| 41 | 0 | 0 | 0 | 0 | 0 | 0 |
| 42 | 0 | 0 | 0 | 0 | 0 | 0 |
| 43 | 0 | 0 | 0 | 0 | 0 | 0 |
| 44 | 0 | 0 | 0 | 0 | 0 | 0 |
| 45 | 0 | 0 | 0 | 0 | 0 | 0 |
| 46 | 0 | 0 | 0 | 0 | 0 | 0 |
| 47 | 0 | 0 | 0 | 0 | 0 | 0 |
| 48 | 0 | 0 | 0 | 0 | 0 | 0 |
| 49 | 0 | 0 | 0 | 0 | 0 | 0 |
| 50 | 0 | 0 | 0 | 0 | 0 | 0 |
| 51 | 0 | 0 | 0 | 0 | 0 | 0 |

TABLE 34-continued

| Transition number | Sam165 | Sam166 | Sam167 | Sam168 | Sam169 | Sam170 |
|---|---|---|---|---|---|---|
| 52 | 0 | 0 | 0 | 0 | 0 | 0 |
| 53 | 0 | 0 | 0 | 0 | 0 | 0 |
| 54 | 0 | 0 | 0 | 0 | 0 | 0 |
| 55 | 0 | 0 | 0 | 0 | 0 | 0 |
| 56 | 0 | 0 | 0 | 0 | 0 | 0 |
| 57 | 0 | 0 | 0 | 0 | 0 | 0 |
| 58 | 0 | 0 | 0 | 0 | 0 | 0 |
| 59 | 0 | 0 | 0 | 0 | 0 | 0 |
| 60 | 0 | 0 | 0 | 0 | 0 | 0 |
| 61 | 0 | 0 | 0 | 0 | 0 | 0 |
| 62 | 0 | 0 | 0 | 0 | 0 | 0 |
| 63 | 0 | 0 | 0 | 0 | 0 | 0 |
| 64 | 0 | 0 | 0 | 0 | 0 | 0 |
| 65 | 0 | 0 | 0 | 0 | 0 | 0 |
| 66 | 0 | 0 | 0 | 0 | 0 | 0 |
| 67 | 0 | 0 | 0 | 0 | 0 | 0 |
| 68 | 0 | 0 | 0 | 0 | 0 | 0 |
| 69 | 0 | 0 | 0 | 0 | 0 | 0 |
| 70 | 0 | 0 | 0 | 0 | 0 | 0 |
| 71 | 0 | 0 | 0 | 0 | 0 | 0 |
| 72 | 0 | 0 | 0 | 0 | 0 | 0 |
| 73 | 0 | 0 | 0 | 0 | 0 | 0 |
| 74 | 0 | 0 | 0 | 0 | 0 | 0 |
| 75 | 0 | 0 | 0 | 0 | 0 | 0 |
| 76 | 0 | 0 | 0 | 0 | 0 | 0 |
| 77 | 0 | 0 | 0 | 0 | 0 | 0 |
| 78 | 1 | 0 | 1 | 0 | 0 | 0 |
| 79 | 1 | 0 | 1 | 0 | 0 | 0 |
| 80 | 1 | 0 | 1 | 0 | 0 | 0 |
| 81 | 1 | 0 | 1 | 0 | 0 | 0 |
| 82 | 0 | 0 | 0 | 1 | 1 | 0 |
| 83 | 0 | 0 | 0 | 1 | 1 | 0 |
| 84 | 0 | 0 | 0 | 1 | 1 | 0 |
| 85 | 0 | 0 | 0 | 1 | 1 | 0 |
| 86 | 0 | 0 | 0 | 0 | 0 | 0 |
| 87 | 0 | 0 | 0 | 0 | 0 | 0 |
| 88 | 0 | 0 | 0 | 0 | 0 | 0 |
| 89 | 1 | 1 | 1 | 1 | 1 | 1 |
| 90 | 1 | 1 | 1 | 1 | 1 | 1 |
| 91 | 1 | 1 | 1 | 1 | 1 | 1 |
| 92 | 0 | 0 | 0 | 0 | 0 | 0 |
| 93 | 0 | 0 | 0 | 0 | 0 | 0 |
| 94 | 0 | 0 | 0 | 0 | 0 | 0 |
| 95 | 0 | 0 | 0 | 0 | 1 | 1 |
| 96 | 0 | 0 | 0 | 0 | 1 | 1 |
| 97 | 0 | 0 | 0 | 0 | 1 | 1 |

Samples Sam165 to Sam170 comprise at least one peptide which is characteristic of VIMs. The bacteria present in samples Sam165 to Sam170 therefore express a beta-lactamase which confers on them a resistance to penicillins, to cephalosporins and to carbapenems.

The detection methods described in examples 6 to 11 are particularly advantageous because they make it possible to assay a large number of peptides and at the same time to detect the presence of one or more resistance mechanisms induced by one or more carbapenemases.

Furthermore, the detection is performed in a short time, less than one hour. In fact, only the part of the gradient between 3 and 34 minutes is useful to the analysis. Furthermore, the retention times of the assayed peptides are all below 34 minutes.

In addition, the detection methods described in examples 6 to 11 are more advantageous than the molecular biology methods because they detect the product of the expression of the genes, and not the genes themselves. The detection of a resistance may not have any clinical meaning if this gene is not expressed, or it if is expressed too weakly to lead to an effective resistance. The detection of a peptide characterising a protein characteristic of a resistance mechanism does not have this disadvantage.

Surprisingly, the above examples show that it is possible to attain by mass spectrometry the sensitivity necessary for the specific detection of the existence of a mechanism of resistance to at least one antimicrobial of a microorganism contained in a sample, without employing an amplification method as is usually the case when molecular biology methods are used.

BIBLIOGRAPHIC REFERENCES

[1] J. Anhalt & C. Fenselau, 1975, Anal. Chem., 47(2):219-225.
[2] A. Fox et al., ed., 1990, Analytical microbiology methods: chromatography and mass spectrometry, Plenum Press, New York, N.Y.
[3] M. Claydon et al., 1996, Nature Biotech. 14:1584-1586.
[4] T. Krishnamurthy & P. Ross, 1996, Rapid Com. Mass Spec., 10:1992-1996.
[5] P. Seng et al. 2009, Clin. Infect. Dis., 49:543-551.
[6] C. Fenselau et al., 2008, Appl. Environ. Microbial., 904-906.
[7] S. Hofstadler et al., 2005, Int. J. Mass Spectrom., 242:23-41.
[8] D. Ecker, 2008, Nat. Rev. Microbiol., 6(7):553-558.
[9] Bush and Jacoby, 2010, Antimicrobial Agents and Chemotherapy; 54 (3): 969-976
[10] W.-J. Chen et al., 2008, Anal. Chem., 80: 9612-9621
[11] D. Lopez-Ferrer et al., 2008, Anal. Chem., 80:8930-8936
[12] D. Lopez-Ferrer et al., 2005, J. Proteome res., 4(5): 1569-1574
[13] T. Fortin et al., 2009, Mol. Cell Proteomics, 8(5): 1006-1015.
[14] H. Keshishian et al., 2007, Mol. Cell Proteomics, 2212-2229.
[15] J. Stal-Zeng et al., 2007, Mol. Cell Proteomics, 1809-1817.
[16] Gaskell, Electrospray: principles and practise, 1997, J. Mass Spectrom., 32, 677-688).
[17] V. Fusaro et al., 2009, Nature Biotech. 27, 190-198.
[18] J. Mead et al., 15 Nov. 2008, Mol. Cell Proteomics, E-pub.
[19] F. Desiere et al., 2006, Nucleic Acids Res., 34 (database issue): D655-8).
[20] L. Anderson & C. Hunter, 2006, Mol. Cell Proteomics, 573-588).
[21] B. Han & R. Higgs, 2008, Brief Funct Genomic Proteomic., 7(5):340-54).
[22] K.-Y. Wang et al., 2008, Anal. Chem, 80(16) 6159-6167).
[23] J. Bundy & C. Fenselau, 1999, Anal. Chem. 71: 1460-1463.
[24] K-C Ho et al., 2004, Anal. Chem. 76: 7162-7268.
[25] Y. S. Lin et al., 2005, Anal. Chem., 77: 1753-1760.
[26] S. Vaidyanathan et al., 2001, Anal. Chem., 73:4134-4144.
[27] R. Everley et al., 2009, J. Microbiol. Methods, 77:152-158.
[28] P. Seng et al., 2009, Clin. Infect. Dis., 49:543-551.
[29] Manes N. et al., 2007, Mol. & Cell. Proteomics, 6(4): 717-727.
[30] R. Nandakumar et al., 2009, Oral Microbiology Immunology, 24:347-352).
[31] L. Hernychova et al., 2008, Anal. Chem., 80:7097-7104.
[32] J.-M. Pratt et al., 2006, Nat. Protoc., 1:1029-1043.
[33] V. Brun et al., 2007, Mol. Cell Proteomics, 2139-2149.

SEQUENCE LISTING (1109 sequences)

SEQ ID NO: 1 - protein, 255 aa, Unknown
  resistance gene
MELPNIMHPVAKLSTALAAALMLSGCMPGEIRPTIGQQMETGDQRFGDLVFRQLAPNVWQHTSYLDMPGFGAVASNGLIVRDGGRVLVVDTAWTDDQTAQILNWIKQEINLPVALAVVTHAHQDKMGGMDALHAAGIATYANALSNQLAPQEGMVAAQHSLTFAANGWVEPATAPNFGPLKVFYPGPGHTSDNITVGIDGTDIAFGGCLIKDSKAKSLGNLGDADTEHYAASARAFGAAFPKASMIVMSHSAPDS

SEQ ID NO: 2 - protein, 8 aa, Unknown
  resistance gene
AAITHTAR

SEQ ID NO: 3 - protein, 8 aa, Unknown
  resistance gene
AFGAAFPK

SEQ ID NO: 4 - protein, 14 aa, Unknown
  resistance gene
ASMIVMSHSAPDSR

SEQ ID NO: 5 - protein, 7 aa, Unknown
  resistance gene
FGDLVFR

SEQ ID NO: 6 - protein, 12 aa, Unknown
  resistance gene
MELPNIMHPVAK

SEQ ID NO: 7 - protein, 19 aa, Unknown
  resistance gene
QEINLPVALAVVTHAHQDK

SEQ ID NO: 8 - protein, 18 aa, Unknown
  resistance gene
SLGNLGDADTEHYAASAR

SEQ ID NO: 9 - protein, 21 aa, Unknown
  resistance gene
VLVVDTAWTDDQTAQILNWIK

SEQ ID NO: 10 - protein, 293 aa, Unknown
  resistance gene
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVPWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGVYGTANDYAVVWPTGRAPIVLAVYTRAPNKDDKHSEAVIAAAARLALEGLGVNGQ

SEQ ID NO: 11 - protein, 293 aa, Unknown
  resistance gene
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVPWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGVYGTANDYAVVWPTGRAPIVLAVYTRAPNKDDKYSEAVIAAAARLALEGLGVNGQ

SEQ ID NO: 12 - protein, 293 aa, Unknown
  resistance gene
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVRWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGGYGTANDYAVVWPTGRAPIVLAVYTRAPNKDDKHSEAVIAAAARLALEGLGVNGQ

SEQ ID NO: 13 - protein, 293 aa, Unknown
  resistance gene
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVRWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGVYGTANDYAVVWPTGRAPIVLAVYTRAPNKDDKHSEAVIAAAARLALEGLGVNGQ

SEQ ID NO: 14 - protein, 293 aa, Unknown
  resistance gene
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVPWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGGYGTANDYAVVWPTGRAPIVLAVYTRAPNKDDKHSEAVIAAAARLALEGLGVNGQ

SEQ ID NO: 15 - protein, 293 aa, Unknown
  resistance gene
MSLYRRLVLLSCLSWPLAGFSATALTNLVAEPFAKLEQDFGGSIGVYAIDTGSGATVSYRAEERFPLCSSFKGFLAAAVLARSQQQAGLLDTPIRYGKNALVPWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGVYGTANDYAVVWPTGRAPIVLAVYTRAPNKDDKYSEAVIAAAARLALEGLGVNGQ

SEQ ID NO: 16 - protein, 293 aa, Unknown
  resistance gene
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVPWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGGYGTANDYAVVWPTGRAPIVLAVYTRAPNKDDKYSEAVIAAAARLALEGLGVNGQ

SEQ ID NO: 17 - protein, 289 aa, Unknown
  resistance gene
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVPWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGAYGTANDYAVVWPTGRAPIVLAVYTRAPNKDDKYSEAVIAAAARLALEGLG

SEQ ID NO: 18 - protein, 293 aa, Unknown
  resistance gene
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVRWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGVYGTANDYAVVWPTGRAPIVLAVYTRAPNKDDKYSEAVIAAAARLALEGLGVNGQ

SEQ ID NO: 19 - protein, 293 aa, Unknown
  resistance gene
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVLWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGVYGTANDYAVVWPTGRAPIVLAVYTRAPNKDDKHSEAVIAAAARLALEGLGVNGQ

SEQ ID NO: 20 - protein, 12 aa, Unknown
  resistance gene
AAVPADWAVGDK

SEQ ID NO: 21 - protein, 10 aa, Unknown
  resistance gene
APIVLAVYTR

SEQ ID NO: 22 - protein, 8 aa, Unknown
  resistance gene
AVTESLQK

SEQ ID NO: 23 - protein, 13 aa, Unknown
  resistance gene
ELGGPAGLTAFMR

SEQ ID NO: 24 - protein, 8 aa, Unknown
  resistance gene
FPLCSSFK

SEQ ID NO: 25 - protein, 10 aa, Unknown
  resistance gene
GFLAAAVLAR

SEQ ID NO: 26 - protein, 8 aa, Unknown
  resistance gene
GNTTGNHR

SEQ ID NO: 27 - protein, 11 aa, Unknown
  resistance gene
LALEGLGVNGQ

SEQ ID NO: 28 - protein, 12 aa, Unknown
  resistance gene
LTLGSALAAPQR

SEQ ID NO: 29 - protein, 12 aa, Unknown
  resistance gene
NALVPWSPISEK

SEQ ID NO: 30 - protein, 8 aa, Unknown
  resistance gene
QQFVDWLK

SEQ ID NO: 31 - protein, 8 aa, Unknown
  resistance gene
SIGDTTFR

SEQ ID NO: 32 - protein, 13 aa, Unknown
  resistance gene
SQQQAGLLDTPIR

SEQ ID NO: 33 - protein, 14 aa, Unknown
  resistance gene
WELELNSAIPGDAR

SEQ ID NO: 34 - protein, 287 aa, Unknown
  resistance gene
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 35 - protein, 287 aa, Unknown
  resistance gene
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVKWSPATERFLASGHMTVLEAAQAAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 36 - protein, 287 aa, Unknown
  resistance gene
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQLAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 37 - protein, 287 aa, Unknown
  resistance gene
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMNDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 38 - protein, 287 aa, Unknown
  resistance gene
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMSDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 39 - protein, 287 aa, Unknown
  resistance gene
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVKWSPATERFLASGHMTVLEAAQAAVQLSDNGATNLLLREIGGPAAMTQYFRKIGDSVSRLDRKEPEMSDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 40 - protein, 287 aa, Unknown
  resistance gene
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGSRNDIGFFKAQERDYAVAVYTTAPKLSAVERDELVASVGQVITQLILSTDK

SEQ ID NO: 41 - protein, 287 aa, Unknown
  resistance gene
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGARNDIGFFKAQERDYAVAVYTTAPKLSAVERDELVASVGQVITQLILSTDK

SEQ ID NO: 42 - protein, 287 aa, Unknown
  resistance gene
MRFIHALLLAGTAHSAYASEKLTFKTDLEKLEREKAAQIGVAIVDPQGEIVAGHRTAQRFAMCSTFKFPLAALVFERIDSGTERGDRKLSYGPDMIVEWSPATERFLASGHMTVLEAAQAAVQLCDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 43 - protein, 287 aa, Unknown
  resistance gene
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVKWSPATERFLASGHMTVLEAAQAAVQLSDNGATNLLLREIGGPAAMTQYFRKIGDSVSRLDRKEPEMNDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 44 - protein, 287 aa, Unknown
  resistance gene
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKESEMSDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 45 - protein, 287 aa, Unknown
  resistance gene
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMSDNTPGDLRDTTTPIAMARTVAKVLYGGALTSTSTHTIERWLIGNQTGDATLRAGFPKDWVVGEKTGTCANGARNDIGFFKAQERDYAVAVYTTAPKLSAVERDELVASVGQVITQLILSTDK

SEQ ID NO: 46 - protein, 287 aa, Unknown
  resistance gene
MRFIHALLLAGIAHSAYASEKLTFKTDLEKLEREKAAEIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMSDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 47 - protein, 287 aa, Unknown
  resistance gene
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVKWSPATERFLASGHMTVLEAAQAAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGARNDIGFFKAQERDYAVAVYTTAPKLSAVERDELVASVGQVITQLILSTDK

SEQ ID NO: 48 - protein, 287 aa, Unknown
  resistance gene
MRFIHALLLAGIAHSAYASEKLTFKTDLEKLEREKAAQIGVAIVDPQGEIVAGHRTAQRFAMCSTFKFPLAALVFERIDSGTERGDRKLSYGPDMIVKWSPATERFLASGHMTVLEAAQAAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 49 - protein, 287 aa, Unknown
  resistance gene
MRFIHALLLAGIAHSAYASEKLTFKTDLEKLEREKAAQIGVAIVDPQGEIVAGHRTAQRFAMCSTFKFPLAALVFERIDSGTERGDRKLSYGPDMIVKWSPATERFLASGHMTVLEAAQAAVQLSDNGATNLLLREIGGPAAMTQYFRKIGDSVSRLDRKEPEMSDNTPGDLRDTTTPIAMARTVAKVLYGGALTSTSTHTIERWLIGNQTGDATLRAGFPKDWVVGEKTGTCANGGRNDIGFFKAQERDYAVAVYTTAPKLSAVERDELVASVGQVITQLILSTDK

SEQ ID NO: 50 - protein, 287 aa, Unknown
  resistance gene
MRFIHALLLAGIAHSAYASEKLTFKTDLEKLEREKAAQIGVAIVDPQGEIVAGHRMAQRFAMCSTFKFPLAALVFERIDSGTERGDRKLSYGPDMIVEWSPATERFLASGHMTVLEAAQAAVQLSDNGATNLLLREIGGPAAMTQYFRKIGDSVSRLDRKEPEMGDNTPGDLRDTTTPIAMARTVAKVLYGGALTSTSTHTIERWLIGNQTGDATLRAGFPKDWVVGEKTGACANGARNDIGFFKAQERDYAVAVYTTAPKLSAVERDELVASVGQVITQLILSTDK

SEQ ID NO: 51 - protein, 20 aa, Unknown
  resistance gene
AAEIGVAIVDPQGEIVAGHR

SEQ ID NO: 52 - protein, 20 aa, Unknown
  resistance gene
AAQIGVAIVDPQGEIVAGHR

SEQ ID NO: 53 - protein, 5 aa, Unknown
  resistance gene
AGFPK

SEQ ID NO: 54 - protein, 10 aa, Unknown
  resistance gene
DTTTPIAMAR

SEQ ID NO: 55 - protein, 7 aa, Unknown
  resistance gene
DWVVGEK

SEQ ID NO: 56 - protein, 12 aa, Unknown
  resistance gene
DYAVAVYTTAPK

SEQ ID NO: 57 - protein, 13 aa, Unknown
  resistance gene
EIGGPAAMTQYFR

SEQ ID NO: 58 - protein, 13 aa, Unknown
  resistance gene
EPEMGDNTPGDLR

SEQ ID NO: 59 - protein, 13 aa, Unknown
  resistance gene
EPEMNDNTPGDLR

SEQ ID NO: 60 - protein, 13 aa, Unknown
  resistance gene
EPEMSDNTPGDLR

SEQ ID NO: 61 - protein, 13 aa, Unknown
  resistance gene
ESEMSDNTPGDLR

SEQ ID NO: 62 - protein, 8 aa, Unknown
  resistance gene
FAMCSTFK

SEQ ID NO: 63 - protein, 19 aa, Unknown
  resistance gene
FIHALLLAGIAHSAYASEK

SEQ ID NO: 64 - protein, 19 aa, Unknown
  resistance gene
FIHALLLAGTAHSAYASEK

SEQ ID NO: 65 - protein, 10 aa, Unknown
  resistance gene
FPLAALVFER

SEQ ID NO: 66 - protein, 7 aa, Unknown
  resistance gene
IDSGTER

SEQ ID NO: 67 - protein, 7 aa, Unknown
  resistance gene
IGDSVSR

SEQ ID NO: 68 - protein, 6 aa, Unknown
  resistance gene
LSAVER

SEQ ID NO: 69 - protein, 17 aa, Unknown
  resistance gene
LSYGPDMIVEWSPATER

SEQ ID NO: 70 - protein, 10 aa, Unknown
  resistance gene
LSYGPDMIVK

SEQ ID NO: 71 - protein, 7 aa, Unknown
  resistance gene
NDIGFFK

SEQ ID NO: 72 - protein, 5 aa, Unknown
  resistance gene
TDLEK

SEQ ID NO: 73 - protein, 9 aa, Unknown
  resistance gene
TGACANGAR

SEQ ID NO: 74 - protein, 9 aa, Unknown
  resistance gene
TGTCANGAR

SEQ ID NO: 75 - protein, 9 aa, Unknown
  resistance gene
TGTCANGGR

SEQ ID NO: 76 - protein, 9 aa, Unknown
  resistance gene
TGTCANGSR

SEQ ID NO: 77 - protein, 17 aa, Unknown
  resistance gene
VLYGGALTSTSTHTIER

SEQ ID NO: 78 - protein, 13 aa, Unknown
  resistance gene
WLIGNQTGDATLR

SEQ ID NO: 79 - protein, 7 aa, Unknown
  resistance gene
WSPATER

SEQ ID NO: 80 - protein, 246 aa, Unknown
  resistance gene
MSKLSVFFIFLFCSIATAAESLPDLKIEKLDEGVYVHTSFEEVNGWGVVPKHGLVVLVNAEAYLIDTPFTAKDTEKLVTWFVERGYKIKGSISSHFHSDSTGGIEWLNSRSIPTYASELTNELLKKDGKVQATNSFSGVNYWLVKNKIEVFYPGPGHTPDNVVVWLPERKILFGGCFIKPYGLGNLGDANIEAWPKSAKLLKSKYGKAKLVVPSHSEVGDASLLKLTLEQAVKGLNESKKPSKPSN

SEQ ID NO: 81 - protein, 246 aa, Unknown
  resistance gene
MKKLSVFFMFLFCSIAASGEALPDLKIEKLDEGVYVHTSFEEVNGWGVVPKHGLVVLVNTDAYLIDTPFTAKDTEKLVTWFVERGYKIKGSISSHFHSDSTGGIEWLNSQSIPTYASELTNELLKKDGKVQAKNSFSGASYWLVKKKIEIFYPGPGHTPDNVVVWLPEHRVLFGGCFVKPYGLGNLGDANLEAWPKSAKLLVSKYGKAKLVVPSHSEVGDASLLKRTLEQAVKGLNESKKLSKPSN

SEQ ID NO: 82 - protein, 246 aa, Unknown
  resistance gene
MSKLSVFFIFLFCSIATAAEPLPDLKIEKLDEGVYVHTSFEEVNGWGVVPKHGLVVLVDAEAYLIDTPFTAKDTEKLVTWFVERGYKIKGSISSHFHSDSTGGIEWLNSQSIPTYASELTNELLKKDGKVQAKNSFGGVNYWLVKNKIEVFYPGPGHTPDNLVVWLPERKILFGGCFIKPYGLGNLGDANLEAWPKSAKLLISKYGKAKLVVPSHSEAGDASLLKLTLEQAVKGLNESKKPSKLSN

SEQ ID NO: 83 - protein, 246 aa, Unknown
  resistance gene
MKKLFVLCVCFLCSITAAGAALPDLKIEKLEEGVYVHTSFEEVNGWGVVSKHGLVVLVNTDAYLIDTPFTATDTEKLVNWFVERGYKIKGTISSHFHSDSTGGIEWLNSQSIPTYASELTNELLKKDGKVQAKNSFSGVSYWLVKNKIEVFYPGPGHTQDNVVVWLPEKKILFGGCFVKPDGLGNLGDANLEAWPKSAKILMSKYGKAKLVVSSHSEIGDASLLKRTWEQAVKGLNESKKPSQPSN

SEQ ID NO: 84 - protein, 246 aa, Unknown
  resistance gene
MSKLFVFFMFLFCSITAAAESLPDLKIEKLDEGVYVHTSFEEVNGWGVVPKHGLVVLVNTEAYLIDTPFTAKDTEKLVTWFVERGYKIKGSISSHFHSDSTGGIEWLNSQSIPTYASELTNELLKKDGKVQAKNSFSGASYWLVKKKIEVFYPGPGHTPDNVVVWLPENRVLFGGCFVKPYGLGNLGDANVEAWPKSAKLLMSKYGKAKLVVPSHSEVGDASLLKRTLEQAVKGLNESKKPSKPSN

SEQ ID NO: 85 - protein, 245 aa, Unknown
  resistance gene
MSKLFVFFMFLFCSITAAGESLPDLKIEKLDEGVYVHTSFEEVNGWGVIPKHGLVVLVNTDAYLIDTPFTAKDTENLVNWFVERGYRIKGSISSHFHSDSTGGIEWLNSQSIPTYASELTNELLKKDGKVQAKYSFSGVSYWLVKKKIEVFYPGPGHAPDNVVVWLPENRVLFGGCFVKPYGLGNLGDANLEAWPKSAKLLMSKYSKAKLVVPSHSDIGDSSLLKLTWEQTVKGFNESKKSTTAH

SEQ ID NO: 86 - protein, 246 aa, Unknown
  resistance gene
MKKLFVLCVFFFCNIAVAEESLPDLKIEKLEEGVYVHTSFEEVKGWSVVTKHGLVVLVKNDAYLIDTPITAKDTEKLVNWFVERGYKIKGSISTHFHGDSTAGIEWLNSQSIPTYASELTNELLKKDNKVQAKHSFNGVSYSLIKNKIEVFYPGPGHTQDNVVVWLPEKKILFGGCFVKPDGLGYLGDANLEAWPKSAKILMSKYGKAKLVVSSHSDIGDVSLLKRTWEQAVKGLNESKKSSQPSD

SEQ ID NO: 87 - protein, 246 aa, Unknown
  resistance gene
MNKLSVFFMFMFCSITAAGESLPDLKIEKLDEGVYVHTSFEEVNGWGVVPKHGLVVLVNTEAYLIDTPFTAKDTEKLVTWFVERGYKIKGSISSHFHSDSTGGIEWLNSQSIPTYASELTNELLKKDGKVQAKNSFSGGSYWLVNNKIEVFYPGPGHTPDNVVVWLPENRVLFGGCFVKPYGLGNLGDANLEAWPKSAKILMSKYGKAKLVVSSHSETGNASLLKLTWEQAVKGLKESKKPSLPSN

SEQ ID NO: 88 - protein, 246 aa, Unknown
  resistance gene
MKKLFVLCVFFLCNIAAADDSLPDLKIEKLEKGVYVHTSFEEVKGWGVVTKHGLVVLVKNDAYLIDTPITAKDTEKLVNWFIEHGYRIKGSISTHFHGDSTAGIEWLNSQSISTYASELTNELLKKDNKVQATNSFSGVSYSLIKNKIEVFYPGPGHTQDNVVVWLPEKKILFGGCFVKPDGLGNLGDANLEAWPKSAKILMSKYGKAKLVVSSHSEIGNASLLQRTWEQAVKGLNESKKPLQPSS

SEQ ID NO: 89 - protein, 246 aa, Unknown
  resistance gene
MKKLFVLCVFLFCSITAAGESLPDLKIEKLEEGVYVHTSFEEVNGWGVVSKHGLVILVNTDAYLIDTPFTAKDTEKLVTWFVERGYKIKGSISSHFHSDSTGGIEWLNSQSIPTYASELTNDLLKQNGKVQAKNSFSGVSYWLVKNKIEVFYPGPGHTQDNVVVWLPEKKILFGGCFVKPYGLGNLDDANVVAWPHSAEILMSRYGNAKLVVPSHSDIGDASLLKLTWEQAVKGLKESKKPSEPSN

SEQ ID NO: 90 - protein, 246 aa, Unknown
  resistance gene
MSKLSVFFIFLFCSIATAAESLPDLKIEKLDEGVYVHTSFKEVNGWGVVPKHGLVVLVNAEAYLIDTPFTAKDTEKLVTWFVERGYKIKGSISSHFHSDSTGGIEWLNSRSIPTYASELTNELLKKDGKVQATNSFSGVNYWLVKNKIEVFYPGPGHTPDNVVVWLPERKILFGGCFIKPYGLGNLGDANIEAWPKSAKLLKSKYGKAKLVVPSHSEVGDASLLKLTLEQAVKGLNESKKPSKPSN

SEQ ID NO: 91 - protein, 246 aa, Unknown
  resistance gene
MKKLFVLCVCFLCSITAAGAALPDLKIEKLEEGVYVHTSFEEVNGWGVVSKHGLVVLVNTDAYLIDTPFTATDTEKLVNWFVERGYKIKGTISSHFHSDSTGGIEWLNSQSIPTYASELTNELLKKDGKVQAKNSFSGVSYWLVKNKIEVFYPGPGHTQDNVVVWLPEKKILFGGCFVKPDGLGNLGDANLEAWPKSAKILMSKYVKAKLVVSSHSEIGDASLLKRTWEQAVKGLNESKKPSQPSN

SEQ ID NO: 92 - protein, 246 aa, Unknown
  resistance gene
MKKLFVLCVCFLCSITAAGAALPDLKIEKLEEGVYVHTSFEEVNGWGVVSKHGLVVLVNTDAYLIDTPFTATDTEKLVNWFVERGYKIKGTISSHFHSDSTGGIEWLNSQSIPTYASELTNELLKKDGKVQAKNSFSGVSYWLVKNKIEVFYPGPGHTQDNVVVWLPEKKILFGGCFVKPDGLGNLGDANLEAWPKSAKILMSKYGKAKLVVSSHSEIGDASLLKRTWEQAVKGLNESRKPSQPSN

SEQ ID NO: 93 - protein, 246 aa, Unknown
  resistance gene
MSKLSVFFIFLFCSIATAAESLPDLKIEKLDEGVYVHTSFEEVNGWGVVPKHGLVVLVNAEAYLIDTPFTAKDTEKLVTWFVERGYKIKGSISSHFHSDSTGGIEWLNSRSIPTYASELTNELLKKDGKVQATNSFSGVNYWLVKNKIEVFYPGPGHTPDNVVVWLPERKILFGGCFIKPYGLGNLSDANIEAWPKSAKLLKSKYGKAKLVVPGHSEVGDASLLKLTLEQAVKGLNESKKPSKPSN

SEQ ID NO: 94 - protein, 246 aa, Unknown
  resistance gene
MSKLSVFFIFLFCSIATAAEPLPDLKIEKLDEGVYVHTSFEEVNGWGVFPKHGLVVLVDAEAYLIDTPFTAKDTEKLVTWFVERGYKIKGSISSHFHSDSTGGIEWLNSQSIPTYASELTNELLKKDGKVQAKNSFGGVNYWLVKNKIEVFYPGPGHTPDNLVVWLPERKILFGGCFIKPYGLGNLGDANLEAWPKSAKLLISKYGKAKLVVPSHSEAGDASLLKLTLEQAVKGLNESKKPSKLSN

SEQ ID NO: 95 - protein, 246 aa, Unknown
  resistance gene
MKKLFVLCVFVFCSITVAGETLPNLRVEKLEEGVYVHTSYEEVKGWGVVTKHGLVVLIGADAYLIDTPFTAKDTEKLVNWFVERGYKIKGTVSSHFHSDSTGGIEWLNSQSIPTYASELTNELLKKDGKVQAKNSFDGVSYWLAKDKIEVFYPGPGHTQDNVVVWLPEKEILFGGCFVKPHGLGNLGDANLEAWPESAKILMEKYGKAKLVVSGHSETGDATHLKRTWEQAVKGLKESKKTLQPSN

SEQ ID NO: 96 - protein, 246 aa, Unknown
  resistance gene
MSKLSVFFIFLFCSIATAAESLPDLKIEKLDEGVYVHTSFEEVNGWGVVPKHGLVVLVNAEAYLIDTPFTAKDTEKLVTWFVERGYKIKGSISSHFHSDSTGGIGWLNSRSIPTYASELTNELLKKDGKVQATNSFSGVNYWLVKNKIEVFYPGPGHTPDNVVVWLPERKILFGGCFIKPYGLGNLGDANIEAWPKSAKLLKSKYGKAKLVVPGHSEVGDASLLKLTLEQAVKGLNESKKPSKPSN

SEQ ID NO: 97 - protein, 246 aa, Unknown
  resistance gene
MSKLSVFFIFLFCSIATAAESLPDLKIEKLDEGVYVHTSFEEVNGWGVVPKHGLVVLVNAEAYLIDTPFTAKDTEKLVTWFVERGYKIKGSISSHFHSDSTGGIEWLNSRSIPTYASELTNELLKKDGKVQATNSFSGVNYWLVKNKIEVFYPGPGHTPDNVVVWLPERKILFGGCFIKPYGLGNLGDANIEAWPKSAKLLKSKYGKAKLVVPGHSEVGDASLLKLTLEQAVKGLNESKKPSKPSN

SEQ ID NO: 98 - protein, 246 aa, Unknown
  resistance gene
MSKLSVFFIFLFCSIATAAESLPDLKIEKLDEGVYVHTSFEEVNGWGVFPKHGLVVLVNAEAYLIDTPFTAKDTEKLVTWFVERGYKIKGSISSHFHSDSTGGIEWLNSRSIPTYASELTNELLKKDGKVQATNSFSGVNYWLVKNKIEVFYPGPGHTPDNVVVWLPERKILFGGCFIKPYGLGNLGDANIEAWPKSAKLLKSKYGKAKLVVPSHSEVGDASLLKLTLEQAVKGLNESKKPSKPSN

SEQ ID NO: 99 - protein, 245 aa, Unknown
  resistance gene
MKKLFVLCIFLFCSITAAGASLPDLKIEKLEEGVYVHTSFEEVNGWGVVSKHGLVVLVNTDAYLIDTPFTAKDTEKLVNWFVERGYKIKGSISSHFHSDSTGGIEWLNSQSIPTYASVLTNELLKKDGKVQAKNSFSGVSYWLVKNKIEVFYPGPGHTQDNVVVWLPKNKILFGGCFVKPYGLGNLDDANVEAWPHSAEKLISKYGNAKLVVPSHSDIGDASLLKLTWEQAVKGLNESKKSNTVH

SEQ ID NO: 100 - protein, 246 aa, Unknown
  resistance gene
MKKLFVLCVCFLCSITAAGAALPDLKIEKLEEGVYVHTSFEEVNGWGVFSKHGLVVLVNTDAYLIDTPFTATDTEKLVNWFVERGYKIKGTISSHFHSDSTGGIEWLNSQSIPTYASELTNELLKKDGKVQAKNSFSGVSYWLVKNKIEVFYPGPGHTQDNVVVWLPEKKILFGGCFVKPDGLGNLGDANLEAWPKSAKILMSKYVKAKLVVSSHSEIGDASLLKRTWEQAVKGLNESKKPSQPSN

SEQ ID NO: 101 - protein, 245 aa, Unknown
  resistance gene
MKKLFVLCIFLFCSITAAGASLPDLKIEKLEEGVYVHTSFEEVNGWGVASKHGLVVLVNTDAYLIDTPFTAKDTEKLVNWFVERGYKIKGSISSHFHSDSTGGIEWLNSQSIPTYASVLTNELLKKDGKVQAKNSFSGVSYWLVKNKIEVFYPGPGHTQDNVVVWLPKNKILFGGCFVKPYGLGNLDDANVEAWPHSAEKLISKYGNAKLVVPSHSDIGDASLLKLTWEQAVKGLNESKKSNTVH

SEQ ID NO: 102 - protein, 246 aa, Unknown
  resistance gene
MKKLFVLCVCFLCSITAAGARLPDLKIEKLEEGVYVHTSFEEVNGWGVVSKHGLVVLVNTDAYLIDTPFTATDTEKLVNWFVERGYKIKGTISSHFHSDSTGGIEWLNSQSIPTYASELTNELLKKDGKVQAKNSFSGVSYWLVKNKIEVFYPGPGHTQDNVVVWLPEKKILFGGCFVKPDGLGNLGDANLEAWPKSAKILMSKYVKAKLVVSSHSEIGDASLLKRTWEQAVKGLNESKKPSQPSN

SEQ ID NO: 103 - protein, 246 aa, Unknown
  resistance gene
MKKLFVLCIFLFLSITASGEVLPDLKIEKLEEGVYLHTSFEEVSGWGVVTKHGLVVLVNNDAYLIDTPFTNKDTEKLVAWFVGRGFTIKGSVSSHFHSDSTGGIEWLNSQSIPTYASELTNELLKKNGKVQATNSFSGVSYWLVKNKIEIFYPGPGHTQDNVVVWLPENKILFGGCFVKPDGLGNLDDANLKAWPKSAKILMSKYGKAKLVVSGHSEIGNASLLKLTWEQAVKGLKESKKPLLPSN

SEQ ID NO: 104 - protein, 246 aa, Unknown
  resistance gene
MKKLFVLCVCFFCSITAAGAALPDLKIEKLEEGVFVHTSFEEVNGWGVVTKHGLVVLVNTDAYLIDTPFTATDTEKLVNWFVERGYEIKGTISSHFHSDSTGGIEWLNSQSIPTYASELTNELLKKSGKVQAKYSFSEVSYWLVKNKIEVFYPGPGHTQDNLVVWLPESKILFGGCFIKPHGLGNLGDANLEAWPKSAKILMSKYGKAKLVVSSHSEKGDASLMKRTWEQALKGLKESKKTSSPSN

SEQ ID NO: 105 - protein, 246 aa, Unknown
  resistance gene
MKKLFVLCIFLFCSITAAGESLPDLKIEKLEDGVYVHTSFEEVNGWGVVTKHGLVFLVNTDAYLIDTPFAAKDTEKLVNWFVERGYKIKGSISSHFHSDSSGGIEWLNSQSIPTYASELTNELLKKNGKVQAKNSFSGVSYWLLKNKIEIFYPGPGHTQDNVVVWLPEKKILFGGCFVKPYGLGNLDDANVEAWPHSAEILMSRYGNAKLVVPSHSDVGDASLLKLTWEQAVKGLKESKKPSQPSN

SEQ ID NO: 106 - protein, 12 aa, Unknown
  resistance gene
DTENLVNWFVER

SEQ ID NO: 107 - protein, 10 aa, Unknown
  resistance gene
EILFGGCFVK

SEQ ID NO: 108 - protein, 10 aa, Unknown
  resistance gene
EVNGWGVVPK

SEQ ID NO: 109 - protein, 7 aa, Unknown
  resistance gene
GDASLMK

SEQ ID NO: 110 - protein, 6 aa, Unknown
  resistance gene
GFNESK

SEQ ID NO: 111 - protein, 5 aa, Unknown
  resistance gene
GFTIK

SEQ ID NO: 112 - protein, 6 aa, Unknown
  resistance gene
GLNESK

SEQ ID NO: 113 - protein, 6 aa, Unknown
  resistance gene
GLNESR

SEQ ID NO: 114 - protein, 21 aa, Unknown
  resistance gene
GSISSHFHSDSTGGIEWLNSR

SEQ ID NO: 115 - protein, 21 aa, Unknown
  resistance gene
GSISSHFHSDSTGGIGWLNSR

SEQ ID NO: 116 - protein, 12 aa, Unknown
  resistance gene
GVYVHTSFEEVK

SEQ ID NO: 117 - protein, 7 aa, Unknown
  resistance gene
GWGVVTK

SEQ ID NO: 118 - protein, 7 aa, Unknown
  resistance gene
GWSVVTK

SEQ ID NO: 119 - protein, 5 aa, Unknown
  resistance gene
GYEIK

SEQ ID NO: 120 - protein, 21 aa, Unknown
  resistance gene
HGLVFLVNTDAYLIDTPFAAK

SEQ ID NO: 121 - protein, 21 aa, Unknown
  resistance gene
HGLVILVNTDAYLIDTPFTAK

SEQ ID NO: 122 - protein, 21 aa, Unknown
  resistance gene
HGLVVLIGADAYLIDTPFTAK

SEQ ID NO: 123 - protein, 21 aa, Unknown
  resistance gene
HGLVVLVDAEAYLIDTPFTAK

SEQ ID NO: 124 - protein, 8 aa, Unknown
  resistance gene
HGLVVLVK

SEQ ID NO: 125 - protein, 21 aa, Unknown
  resistance gene
HGLVVLVNAEAYLIDTPFTAK

SEQ ID NO: 126 - protein, 21 aa, Unknown
  resistance gene
HGLVVLVNNDAYLIDTPFTNK

SEQ ID NO: 127 - protein, 21 aa, Unknown
  resistance gene
HGLVVLVNTDAYLIDTPFTAK

SEQ ID NO: 128 - protein, 21 aa, Unknown
  resistance gene
HGLVVLVNTEAYLIDTPFTAK

SEQ ID NO: 129 - protein, 12 aa, Unknown
  resistance gene
HSFNGVSYSLIK

SEQ ID NO: 130 - protein, 21 aa, Unknown
  resistance gene
IEVFYPGPGHTQDNVVVWLPK

SEQ ID NO: 131 - protein, 9 aa, Unknown
  resistance gene
ILFGGCFIK

SEQ ID NO: 132 - protein, 9 aa, Unknown
  resistance gene
ILFGGCFVK

SEQ ID NO: 133 - protein, 5 aa, Unknown
  resistance gene
ILMEK

SEQ ID NO: 134 - protein, 5 aa, Unknown
  resistance gene
ILMSK

SEQ ID NO: 135 - protein, 12 aa, Unknown
  resistance gene
LDEGVYVHTSFK

SEQ ID NO: 136 - protein, 15 aa, Unknown
  resistance gene
LEEGVYVHTSFEEVK

SEQ ID NO: 137 - protein, 15 aa, Unknown
  resistance gene
LEEGVYVHTSYEEVK

SEQ ID NO: 138 - protein, 18 aa, Unknown
  resistance gene
LFVLCVCFLCSITAAGAR

SEQ ID NO: 139 - protein, 5 aa, Unknown
  resistance gene
LLISK

SEQ ID NO: 140 - protein, 5 aa, Unknown
  resistance gene
LLMSK

SEQ ID NO: 141 - protein, 5 aa, Unknown
  resistance gene
LLVSK

SEQ ID NO: 142 - protein, 5 aa, Unknown
  resistance gene
LPDLK

SEQ ID NO: 143 - protein, 8 aa, Unknown
  resistance gene
LTLEQAVK

SEQ ID NO: 144 - protein, 8 aa, Unknown
  resistance gene
LTWEQAVK

SEQ ID NO: 145 - protein, 8 aa, Unknown
  resistance gene
LTWEQTVK

SEQ ID NO: 146 - protein, 8 aa, Unknown
  resistance gene
LVAWFVGR

SEQ ID NO: 147 - protein, 11 aa, Unknown
  resistance gene
LVNWFIEHGYR

SEQ ID NO: 148 - protein, 8 aa, Unknown
  resistance gene
LVNWFVER

SEQ ID NO: 149 - protein, 8 aa, Unknown
  resistance gene
LVTWFVER

SEQ ID NO: 150 - protein, 16 aa, Unknown
  resistance gene
LVVPGHSEVGDASLLK

SEQ ID NO: 151 - protein, 16 aa, Unknown
  resistance gene
LVVPSHSDIGDASLLK

SEQ ID NO: 152 - protein, 16 aa, Unknown
  resistance gene
LVVPSHSDIGDSSLLK

SEQ ID NO: 153 - protein, 16 aa, Unknown
  resistance gene
LVVPSHSDVGDASLLK

SEQ ID NO: 154 - protein, 16 aa, Unknown
  resistance gene
LVVPSHSEAGDASLLK

SEQ ID NO: 155 - protein, 16 aa, Unknown
  resistance gene
LVVPSHSEVGDASLLK

SEQ ID NO: 156 - protein, 16 aa, Unknown
  resistance gene
LVVSGHSEIGNASLLK

SEQ ID NO: 157 - protein, 16 aa, Unknown
  resistance gene
LVVSGHSETGDATHLK

SEQ ID NO: 158 - protein, 16 aa, Unknown
  resistance gene
LVVSSHSDIGDVSLLK

SEQ ID NO: 159 - protein, 16 aa, Unknown
  resistance gene
LVVSSHSEIGDASLLK

SEQ ID NO: 160 - protein, 17 aa, Unknown
  resistance gene
LVVSSHSEIGNASLLQR

SEQ ID NO: 161 - protein, 9 aa, Unknown
  resistance gene
LVVSSHSEK

SEQ ID NO: 162 - protein, 16 aa, Unknown
  resistance gene
LVVSSHSETGNASLLK

SEQ ID NO: 163 - protein, 13 aa, Unknown
  resistance gene
NDAYLIDTPITAK

SEQ ID NO: 164 - protein, 12 aa, Unknown
  resistance gene
NSFDGVSYWLAK

SEQ ID NO: 165 - protein, 12 aa, Unknown
  resistance gene
NSFGGVNYWLVK

SEQ ID NO: 166 - protein, 12 aa, Unknown
  resistance gene
NSFSGASYWLVK

SEQ ID NO: 167 - protein, 14 aa, Unknown
  resistance gene
NSFSGGSYWLVNNK

SEQ ID NO: 168 - protein, 12 aa, Unknown
  resistance gene
NSFSGVSYWLLK

SEQ ID NO: 169 - protein, 12 aa, Unknown
  resistance gene
NSFSGVSYWLVK

SEQ ID NO: 170 - protein, 15 aa, Unknown
  resistance gene
SIPTYASELTNELLK

SEQ ID NO: 171 - protein, 7 aa, Unknown
  resistance gene
TLEQAVK

SEQ ID NO: 172 - protein, 7 aa, Unknown
  resistance gene
TWEQALK

SEQ ID NO: 173 - protein, 7 aa, Unknown
  resistance gene
TWEQAVK

SEQ ID NO: 174 - protein, 9 aa, Unknown
  resistance gene
VLFGGCFVK

SEQ ID NO: 175 - protein, 16 aa, Unknown
  resistance gene
VQATNSFSGVNYWLVK

SEQ ID NO: 176 - protein, 16 aa, Unknown
  resistance gene
VQATNSFSGVSYSLIK

SEQ ID NO: 177 - protein, 16 aa, Unknown
  resistance gene
VQATNSFSGVSYWLVK

SEQ ID NO: 178 - protein, 5 aa, Unknown
  resistance gene
YGNAK

SEQ ID NO: 179 - protein, 12 aa, Unknown
  resistance gene
YSFSEVSYWLVK

SEQ ID NO: 180 - protein, 12 aa, Unknown
  resistance gene
YSFSGVSYWLVK

SEQ ID NO: 181 - protein, 239 aa, Unknown
  resistance gene
MKKSIRFFIVSILLSPFASAQVKDFVIEPPIKNNLHIYKTFGVFGGKEYSANSMYLVTKKGVVLFDVPWEKIQYQSLMDTIKKRHNLPVVAVFATHSHDDRAGDLSFFNNKGIKTYATAKTNEFLKKDGKATSTEIIKTGKPYRIGGEEFVVDFLGEGHTADNVVVWFPKYNVLDGGCLVKSNSATDLGYIKEANVEQWPKTINKLKAKYSKATLIIPGHDEWKGGGHVEHTLELLNKK

SEQ ID NO: 182 - protein, 243 aa, Unknown
  resistance gene
MKKSIQLLMMSMFLSPLINAQVKDFVIEPPVKPNLYLYKSFGVFGGKEYSANAVYLTTKKGVVLFDVPWQKEQYQTLMDTIQKRHHLPVIAVFATHSHDDRAGDLSFYNQKGIKTYATAKTNELLKKDGKATSTEIIKTGKPYKIGGEEFMVDFLGEGHTVDNVVVWFPKYKVLDGGCLVKSRTATDLGYTGEANVKQWPETMRKLKTKYAQATLVIPGHDEWKGGGHVQHTLDLLDKNKKPE

SEQ ID NO: 183 - protein, 243 aa, Unknown
  resistance gene
MKKSIQLLMMSMFLSPLINAQVKDFVIEPPVKPNLYLYKSFGVFGGKEYSANAVYLTTKKGVVLFDVPWQKEQYQTLMDTIQKRHHLPVIAVFATHSHDDRAGDLSFYNQKGIKTYATAKTNELLKKDGKATSTEIIKTGKPYKIGGEEFMVDFLGEGHTVDNVVVWFPKYKVLDGGCLVKSRTATDLGYTGEANVKQWPETMRKLKTKYAQATLVIPGHEEWKGGGHVQHTLDLLDKNKKPE

SEQ ID NO: 184 - protein, 239 aa, Unknown
  resistance gene
MKKRIQFFMVSMMLSSLFSAQVKDFVIEPPIKKNLHIYKTFGVFGGKEYSANSVYLVTQKGVVLFDVPWEKVQYQSLMDTIQKRHNLPVIAVFATHSHDDRAGDLSFFNNKGIKTYATSKTNEFLKKDGKATSTEIIKTGKPYRIGGEEFVVDFLGEGHTADNVVVWFPKYNVLDGGCLVKSKAATDLGYIKEANVEQWPKTINKLKSKYSKASLVIPGHDEWKGGGHVKHTLELLNKK

SEQ ID NO: 185 - protein, 242 aa, Unknown
  resistance gene
MRKNVRIFTVLSLFLINFFNAQARDFVIEQPFGKQLYLYKTFGVFDGKEYSTNALYLVTKKGVVLFDVPWQKTQYQSLMDTIKKRHNLPVIAVFATHSHSDRAGDLSFYNKKGIPTYATAKTNELLKKEGKATSSKLTKIGKKYKIGGEEFTVDFLGEGHTADNVVVWFPKYNVLDGGCLVKSSAAVDLGYTGEANVEQWPATMKKLQAKYPSTAKVIPGHDEWKGNDHVKHTLELLDQQKQ

SEQ ID NO: 186 - protein, 239 aa, Unknown
  resistance gene
MKKRIQFFMVSMMLAPMFNAQVKDFVIEPPIKNNLHIYKTFGVFGGKEYSANSVYLVTKKGVVLFDVPWEKAQYQSLMDTIKKRHNLPVIAVFATHSHDDRAGDLSFFNNKGIKTYATSKTNEFLKKDGKATSTEIIKTGKPYRIGGEEFTVDFLGEGHTADNVVVWFPKYNVLDGGCLVKSNSATDLGYIKEANVEQWPITIDKLKAKYSKATLIIPGHDDWKGGGHVEHTLELLNKK

SEQ ID NO: 187 - protein, 239 aa, Unknown
  resistance gene
MKRRIQFFMVSMMLTPLFSAQVKDFVIEPPIKKNLYIYKTFGVFGGKEYSANSVYLVTKTGVVLFDVPWEKAQYQSLMDTIKKRHNLPVVAVFATHSHDDRAGDLSFFNNKGIKTYATPKTNQFLKRDGKATSTELIKPGKPYRFGGEEFVVDFLGEGHTADNVVVWFPKYKVLDGGCLVKSNSATDLGYIKEANLEQWPKTMHKLKTKYSEAVLIIPGHDEWKGGGHVEHTLELLDKK

SEQ ID NO: 188 - protein, 9 aa, Unknown
  resistance gene
AATDLGYIK

SEQ ID NO: 189 - protein, 10 aa, Unknown
  resistance gene
AGDLSFFNNK

SEQ ID NO: 190 - protein, 9 aa, Unknown
  resistance gene
AGDLSFYNK

SEQ ID NO: 191 - protein, 10 aa, Unknown
  resistance gene
AGDLSFYNQK

SEQ ID NO: 192 - protein, 11 aa, Unknown
  resistance gene
AQYQSLMDTIK

SEQ ID NO: 193 - protein, 12 aa, Unknown
  resistance gene
ASLVIPGHDEWK

SEQ ID NO: 194 - protein, 12 aa, Unknown
  resistance gene
ATLIIPGHDDWK

SEQ ID NO: 195 - protein, 12 aa, Unknown
  resistance gene
ATLIIPGHDEWK

SEQ ID NO: 196 - protein, 5 aa, Unknown
  resistance gene
ATSSK

SEQ ID NO: 197 - protein, 8 aa, Unknown
  resistance gene
ATSTEIIK

SEQ ID NO: 198 - protein, 8 aa, Unknown
  resistance gene
ATSTELIK

SEQ ID NO: 199 - protein, 11 aa, Unknown
  resistance gene
ATSTELIKPGK

SEQ ID NO: 200 - protein, 14 aa, Unknown
  resistance gene
ATSTELIKPGKPYR

SEQ ID NO: 201 - protein, 9 aa, Unknown
  resistance gene
DFVIEPPIK

SEQ ID NO: 202 - protein, 9 aa, Unknown
  resistance gene
DFVIEPPVK

SEQ ID NO: 203 - protein, 16 aa, Unknown
  resistance gene
DFVIEPPVKPNLYLYK

SEQ ID NO: 204 - protein, 10 aa, Unknown
  resistance gene
DFVIEQPFGK

SEQ ID NO: 205 - protein, 9 aa, Unknown
  resistance gene
EANLEQWPK

SEQ ID NO: 206 - protein, 13 aa, Unknown
  resistance gene
EANVEQWPITIDK

SEQ ID NO: 207 - protein, 9 aa, Unknown
  resistance gene
EANVEQWPK

SEQ ID NO: 208 - protein, 12 aa, Unknown
  resistance gene
EQYQTLMDTIQK

SEQ ID NO: 209 - protein, 12 aa, Unknown
  resistance gene
EYSANAVYLTTK

SEQ ID NO: 210 - protein, 12 aa, Unknown
  resistance gene
EYSANSMYLVTK

SEQ ID NO: 211 - protein, 12 aa, Unknown
  resistance gene
EYSANSVYLVTK

SEQ ID NO: 212 - protein, 13 aa, Unknown
  resistance gene
EYSANSVYLVTQK

SEQ ID NO: 213 - protein, 12 aa, Unknown
  resistance gene
EYSTNALYLVTK

SEQ ID NO: 214 - protein, 17 aa, Unknown
  resistance gene
FFIVSILLSPFASAQVK

SEQ ID NO: 215 - protein, 14 aa, Unknown
  resistance gene
GGGHVEHTLELLDK

SEQ ID NO: 216 - protein, 14 aa, Unknown
  resistance gene
GGGHVEHTLELLNK

SEQ ID NO: 217 - protein, 6 aa, Unknown
  resistance gene
GGGHVK

SEQ ID NO: 218 - protein, 14 aa, Unknown
  resistance gene
GGGHVQHTLDLLDK

SEQ ID NO: 219 - protein, 9 aa, Unknown
  resistance gene
GIPTYATAK

SEQ ID NO: 220 - protein, 6 aa, Unknown
  resistance gene
GNDHVK

SEQ ID NO: 221 - protein, 11 aa, Unknown
  resistance gene
GVVLFDVPWEK

SEQ ID NO: 222 - protein, 11 aa, Unknown
  resistance gene
GVVLFDVPWQK

SEQ ID NO: 223 - protein, 17 aa, Unknown
  resistance gene
HHLPVIAVFATHSHDDR

SEQ ID NO: 224 - protein, 17 aa, Unknown
  resistance gene
HNLPVIAVFATHSHDDR

SEQ ID NO: 225 - protein, 17 aa, Unknown
  resistance gene
HNLPVIAVFATHSHSDR

SEQ ID NO: 226 - protein, 17 aa, Unknown
  resistance gene
HNLPVVAVFATHSHDDR

SEQ ID NO: 227 - protein, 10 aa, Unknown
  resistance gene
HTLELLDQQK

SEQ ID NO: 228 - protein, 8 aa, Unknown
  resistance gene
HTLELLNK

SEQ ID NO: 229 - protein, 18 aa, Unknown
  resistance gene
IFTVLSLFLINFFNAQAR

SEQ ID NO: 230 - protein, 19 aa, Unknown
  resistance gene
IQFFMVSMMLAPMFNAQVK

SEQ ID NO: 231 - protein, 19 aa, Unknown
  resistance gene
IQFFMVSMMLSSLFSAQVK

SEQ ID NO: 232 - protein, 19 aa, Unknown
  resistance gene
IQFFMVSMMLTPLFSAQVK

SEQ ID NO: 233 - protein, 11 aa, Unknown
  resistance gene
IQYQSLMDTIK

SEQ ID NO: 234 - protein, 6 aa, Unknown
  resistance gene
NLHIYK

SEQ ID NO: 235 - protein, 6 aa, Unknown
  resistance gene
NLYIYK

SEQ ID NO: 236 - protein, 7 aa, Unknown
  resistance gene
NNLHIYK

SEQ ID NO: 237 - protein, 6 aa, Unknown
  resistance gene
QLYLYK

SEQ ID NO: 238 - protein, 7 aa, Unknown
  resistance gene
QWPETMR

SEQ ID NO: 239 - protein, 8 aa, Unknown
  resistance gene
SFGVFGGK

SEQ ID NO: 240 - protein, 20 aa, Unknown
  resistance gene
SIQLLMMSMFLSPLINAQVK

SEQ ID NO: 241 - protein, 11 aa, Unknown
  resistance gene
SNSATDLGYIK

SEQ ID NO: 242 - protein, 14 aa, Unknown
  resistance gene
TATDLGYTGEANVK

SEQ ID NO: 243 - protein, 8 aa, Unknown
  resistance gene
TFGVFDGK

SEQ ID NO: 244 - protein, 8 aa, Unknown
  resistance gene
TFGVFGGK

SEQ ID NO: 245 - protein, 6 aa, Unknown
  resistance gene
TGKPYK

SEQ ID NO: 246 - protein, 6 aa, Unknown
  resistance gene
TGKPYR

SEQ ID NO: 247 - protein, 12 aa, Unknown
  resistance gene
TGVVLFDVPWEK

SEQ ID NO: 248 - protein, 6 aa, Unknown
  resistance gene
TNEFLK

SEQ ID NO: 249 - protein, 6 aa, Unknown
  resistance gene
TNELLK

SEQ ID NO: 250 - protein, 6 aa, Unknown
  resistance gene
TNQFLK

SEQ ID NO: 251 - protein, 11 aa, Unknown
  resistance gene
TQYQSLMDTIK

SEQ ID NO: 252 - protein, 6 aa, Unknown
  resistance gene
TYATAK

SEQ ID NO: 253 - protein, 6 aa, Unknown
  resistance gene
TYATPK

SEQ ID NO: 254 - protein, 6 aa, Unknown
  resistance gene
TYATSK

SEQ ID NO: 255 - protein, 9 aa, Unknown
  resistance gene
VIPGHDEWK

SEQ ID NO: 256 - protein, 9 aa, Unknown
  resistance gene
VLDGGCLVK

SEQ ID NO: 257 - protein, 12 aa, Unknown
  resistance gene
VQYQSLMDTIQK

SEQ ID NO: 258 - protein, 15 aa, Unknown
  resistance gene
YAQATLVIPGHDEWK

SEQ ID NO: 259 - protein, 15 aa, Unknown
  resistance gene
YAQATLVIPGHEEWK

SEQ ID NO: 260 - protein, 11 aa, Unknown
  resistance gene
YNVLDGGCLVK

SEQ ID NO: 261 - protein, 6 aa, Unknown
  resistance gene
YPSTAK

SEQ ID NO: 262 - protein, 15 aa, Unknown
  resistance gene
YSEAVLIIPGHDEWK

SEQ ID NO: 263 - protein, 294 aa, Unknown
  resistance gene
MSNKVNFKTASFLFSVCLALSAFNAHANKSDAAAKQIKKLEEDFDGRIGVFAIDTGSGNTFGYRSDERFPLCSSFKGFLAAAVLERVQQKKLDINQKVKYESRDLEYHSPITTKYKGSGMTLGDMASAALQYSDNGATNIIMERFLGGPEGMTKFMRSIGDNEFRLDRWELELNTAIPGDKRDTSTPKAVANSLNKLALGNVLNAKEKAIYQNWLKGNTTGDARIRASVPADWVVGDKTGSCGAYGTANDYAVIWPKNRAPLIVSIYTTRKSKDDKHSDKTIAEASRIAIQAID

SEQ ID NO: 264 - protein, 294 aa, Unknown
  resistance gene
MSNKVNFKTASFLFSVCLALSAFNAHANKSDAAAKQIKKLEEDFDGRIGVFAIDTGSGNTFGYRSDERFPLCSSFKGFLAAAVLERVQQKKLDINQKVKYESRDLEYYSPITTKYKGSGMTLGDMASAALQYSDNGATNIIMERFLGGPEGMTKFMRSIGDNEFRLDRWELELNTAIPGDKRDTSTPKAVANSLNKLALGNVLNAKVKAIYQNWLKGNTTGDARIRASVPADWVVGDKTGSCGAYGTANDYAVIWPKNRAPLIVSIYTTRKSKDDKHSDKTIAEASRIAIQAID

SEQ ID NO: 265 - protein, 294 aa, Unknown
  resistance gene
MSNKVNFKTASFLFSVCLALSAFNAHANKSDAAAKQIKKLEEDFDGRIGVFAIDTGSGNTFGYRSDERFPLCSSFKGFLAAAVLERVQQKKLDINQKVKYESRDLEYHSPITTKYKGSGMTLGDMASAALQYSDNGATNIIMERFLGGPEGMTKFMRSIGDNEFRLDRWELELNTAIPGDKRDTSTPKAVANSLNKLALGNVLNAKVKAIYQNWLKGNTTGDARIRASVPADWVVGDKTGSCGAIGTANDYAVIWPKNRAPLIVSIYTTRKSKDDKHSDKTIAEASRIAIQAID

SEQ ID NO: 266 - protein, 8 aa, Unknown
  resistance gene
AIYQNWLK

SEQ ID NO: 267 - protein, 11 aa, Unknown
  resistance gene
APLIVSIYTTR

SEQ ID NO: 268 - protein, 12 aa, Unknown
  resistance gene
ASVPADWVVGDK

SEQ ID NO: 269 - protein, 8 aa, Unknown
  resistance gene
AVANSLNK

SEQ ID NO: 270 - protein, 11 aa, Unknown
  resistance gene
DLEYHSPITTK

SEQ ID NO: 271 - protein, 11 aa, Unknown
  resistance gene
DLEYYSPITTK

SEQ ID NO: 272 - protein, 6 aa, Unknown
  resistance gene
DTSTPK

SEQ ID NO: 273 - protein, 10 aa, Unknown
  resistance gene
FLGGPEGMTK

SEQ ID NO: 274 - protein, 10 aa, Unknown
  resistance gene
GFLAAAVLER

SEQ ID NO: 275 - protein, 8 aa, Unknown
  resistance gene
GNTTGDAR

SEQ ID NO: 276 - protein, 17 aa, Unknown
  resistance gene
IGVFAIDTGSGNTFGYR

SEQ ID NO: 277 - protein, 10 aa, Unknown
  resistance gene
LALGNVLNAK

SEQ ID NO: 278 - protein, 6 aa, Unknown
  resistance gene
LDINQK

SEQ ID NO: 279 - protein, 8 aa, Unknown
  resistance gene
LEEDFDGR

SEQ ID NO: 280 - protein, 6 aa, Unknown
  resistance gene
SDAAAK

SEQ ID NO: 281 - protein, 8 aa, Unknown
  resistance gene
SIGDNEFR

SEQ ID NO: 282 - protein, 21 aa, Unknown
  resistance gene
TASFLFSVCLALSAFNAHANK

SEQ ID NO: 283 - protein, 19 aa, Unknown
  resistance gene
TGSCGAIGTANDYAVIWPK

SEQ ID NO: 284 - protein, 19 aa, Unknown
  resistance gene
TGSCGAYGTANDYAVIWPK

SEQ ID NO: 285 - protein, 7 aa, Unknown
  resistance gene
TIAEASR

SEQ ID NO: 286 - protein, 13 aa, Unknown
  resistance gene
WELELNTAIPGDK

SEQ ID NO: 287 - protein, 8 aa, Unknown
  resistance gene
FPLCSSFK

SEQ ID NO: 288 - protein, 266 aa, Unknown
  resistance gene
MFKLLSKLLVYLTASIMAIASPLAFSVDSSGEYPTVSEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSTRRLAEVEGNEIPTHSLEGLSSSGDAVRFGPVELFYPGAAHSTDNLVVYVPSASVLYGGCAIYELSRTSAGNVADADLAEWPTSIERIQQHYPEAQFVIPGHGLPGGLDLLKHTTNVVKAHTNRSVVE

SEQ ID NO: 289 - protein, 266 aa, Unknown
  resistance gene
MFKLLSKLLVYLTASIMAIASPLAFSVDSSGEYPTVSEIPVGEVRLYQIADGVWSHIATKSFDGAVYPSNGLIVRDGDELLLIDTAWGAKNTAALLAEIEKQIGLPVTRAVSTHFHDDRVGGVDVLRAAGVATYASPSTRRLAEVEGSEIPTHSLEGLSSSGDAVRFGPVELFYPGAAHSTDNLVVYVPSASVLYGGCAIYELSRTSAGNVADADLAEWPTSIERIQQHYPEAQFVIPGHGLPGGLDLLKHTTNVVKAHTNRSVVE

SEQ ID NO: 290 - protein, 266 aa, Unknown
  resistance gene
MLKVISSLLVYMTASVMAVASPLAHSGEPSGEYPTVNEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSTRRLAEAEGNEIPTHSLEGLSSSGDAVRFGPVELFYPGAAHSTDNLVVYVPSANVLYGGCAVHELSRTSAGNVADADLAEWPTSVERIQKHYPEAEVVIPGHGLPGGLDLLQHTANVVKAHKNRSVAE

SEQ ID NO: 291 - protein, 266 aa, Unknown
  resistance gene
MLKVISSLLVYMTASVMAVASPLAHSGEPSGEYPTVNEIPVGEVRLYQIADGVWSHIATQSFDGAVYPSNGLIVRDGDELLLIDTAWGAKNTAALLAEIEKQIGLPVTRAVSTHFHDDRVGGVDVLRKAGVATYASPSTRRLAEAEGNEIPTHSLEGLSSSGDAVRFGPVELFYPGAAHSTDNLVVYVPSANVLYGGCAVLALSRTSAGNVADADLAEWPTSVERIQKHYPEAEVVIPGHGLPGGLDLLQHTANVVTAHKNRSVAE

SEQ ID NO: 292 - protein, 266 aa, Unknown
  resistance gene
MFKLLSKLLVYLTASIMAIASPLAFSVDSSGEYPTVSEIPVGEVRLYQIADGVWSHIATRSFDGAVYPSNGLIVRDGDELLLIDTAWGAKNTAALLAEIEKQIGLPVTRAVSTHFHDDRVGGVDVLRAAGVATYASPSTRRLAEVEGSEIPTHSLEGLSSSGDAVRFGPVELFYPGAAHSTDNLVVYVPSASVLYGGCAIYELSRTSAGNVADADLAEWPTSIERIQQHYPEAQFVIPGHGLPGGLDLLKHTTNVVKAHTNRSVVE

SEQ ID NO: 293 - protein, 266 aa, Unknown
  resistance gene
MFKLLSKLLVYLTASIMAIASPLAFSVDSSGEYPTVSEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSARRLAEVEGNEIPTHSLEGLSSSGDAVRFGPVELFYPGAAHSTDNLVVYVPSASVLYGGCAIYELSRTSAGNVADADLAEWPTSIERIQQHYPEAQFVIPGHGLPGGLDLLKHTTNVVKAHTNRSVVE

SEQ ID NO: 294 - protein, 266 aa, Unknown
  resistance gene
MFKLLSKLLVYLTASIMAIASPLAFSVDSSGEYPTVSEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSIRRLAEVEGNEIPTHSLEGLSSSGDAVRFGPVELFYPGAAHSTDNLVVYVPSASVLYGGCAIYELSRTSAGNVADADLAEWPTSIERIQQHYPEAQFVIPGHGLPGGLDLLKHTTNVVKAHTNRSVVE

SEQ ID NO: 295 - protein, 266 aa, Unknown
  resistance gene
MFKLLSKLLVYLTASIMAIASPLAFSVDSSGEYPTVSEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSTRRLAEVEGNEIPTHSLEGLSSSGDAVRFGPVELFYPGAAHSTDNLVVYVPSASVLYGGCAIYELSRTSAGNVADADLAEWPTSIERIQQHYPEAQYVIPGHGLPGGLDLLKHTTNVVKAHTNRSVVE

SEQ ID NO: 296 - protein, 266 aa, Unknown
  resistance gene
MFKLLSKLLVYLTASIMAIASPLAFSVDSSGEYPTVSEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSTRRLAEVEGSEIPTHSLEGLSSSGDAVRFGPVELFYPGAAHSTDNLVVYVPSASVLYGGCAIYELSRTSAGNVADADLAEWPTSIERIQQHYPEAQFVIPGHGLPGGLDLLKHTTNVVKAHTNRSVVE

SEQ ID NO: 297 - protein, 266 aa, Unknown
  resistance gene
MLKVISSLLVYMTASVMAVASPLAHSGEPSSEYPTVNEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSTRRLAEAEGNEIPTHSLEGLSSSGDAVRFGPVELFYPGAAHSTDNLVVYVPSANVLYGGCAVHELSRTSAGNVADADLAEWPTSVERIQKHYPEAEVVIPGHGLPGGLDLLQHTANVVKAHKNRSVAE

SEQ ID NO: 298 - protein, 266 aa, Unknown
  resistance gene
MLKVISSLLVYMTASVMAVASPLAHSGEPSGEYPTVNEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSTRRLAEAEGNEIPTHSLEGLSSSGDAVRFGPVELFYPGAAHSTDNLVVYVPSANVLYGGCAVHELSSTSAGNVADADLAEWPTSIERIQQHYPEAQFVIPGHGLPGGLDLLKHTTNVVKAHTNRSVVE

SEQ ID NO: 299 - protein, 266 aa, Unknown
  resistance gene
MLKVISSLLFYMTASLMAVASPLAHSGESRGEYPTVSEIPVGEVRLYQIDDGVWSHIATHTFDGVVYPSNGLIVRDGDELLLIDTAWGTKNTVALLAEIEKQIGLPVTRSVSTHFHDDRVGGVDALRAAGVATYASPSTRRLAEAEGNEVPTHSLEGLSSSGDAVRFGPVELFYPGAAHSTDNLVVYVPSANVLYGGCAVLELSRTSAGNVADADLAEWPGSVERIQQHYPEAEVVIPGHGLPGGLDLLQHTANVVKAHTNRSVAE

SEQ ID NO: 300 - protein, 266 aa, Unknown
  resistance gene
MFKLLSKLLVYLTASMMAIASPLAFSVDSSGEYPTVSEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSTRRLAEVEGNEIPTHSLEGLSSSGDAVRFGPVELFYPGAAHSTDNLVVYVPSASVLYGGCAIYELSRTSAGNVADADLAEWPTSIERIQQHYPEAQFVIPGHGLPGGLDLLKHTTNVVKAHTNRSVVE

SEQ ID NO: 301 - protein, 266 aa, Unknown
  resistance gene
MFKLLSKLLVYLTASIMAIASPLAFSVDSSGEYPTVSEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSTRRLAEVEGNEIPTHSLEGLSSSGDAVRFGPVELFYPGAAHSTDNLVVYVPSASVLFGGCAIYELSRTSAGNVADADLAEWPTSIERIQQHYPEAQFVIPGHGLPGGLDLLKHTTNVVKAHTNRSVVE

SEQ ID NO: 302 - protein, 266 aa, Unknown
  resistance gene
MFKLLSKLLVYLTASIMAIASPLAFSVDSSGEYPTVSEIPVGEVRLYQIADGVWLHIATQSFDGAVYPSNGLIVRDGDELLLIDTAWGAKNTAALLAEIEKQIGLPVTRAVSTHFHDDRVGGVDVLRAAGVATYASPSTRRLAEVEGNEIPTHSLEGLSSSGDAVRFGPVELFYPGAAHSTDNLVVYVPSASVLYGGCAIYELSRTSAGNVADADLAEWPTSIERIQQHYPEAQFVIPGHGLPGGLDLLKHTTNVVKAHTNRSVVE

SEQ ID NO: 303 - protein, 266 aa, Unknown
  resistance gene
MFKLLSKLLVYLTASIMAIASPLAFSVDSSGEYPTVSEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSTRRLAEVEGNEIPTHSLEGLSSSGDAVRFGPVELFYPGAAHSTDNLVVYVPSASVLYGGCAIYELSSTSAGNVADADLAEWPTSIERIQQHYPEAQFVIPGHGLPGGLDLLKHTTNVVKAHTNRSVVE

SEQ ID NO: 304 - protein, 266 aa, Unknown
  resistance gene
MLKVISSLLVYMTASVMAVASPLAHSGEPSGEYPTVNEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSTRRLAEAEGNEIPTHSLEGLSSSGDAVRFGPVELFYPGAAHSTDNLVVYVPSAKVLYGGCAVHELSRTSAGNVADADLAEWPTSVERIQKHYPEAEVVIPGHGLPGGLDLLQHTANVVKAHKNRSVAE

SEQ ID NO: 305 - protein, 266 aa, Unknown
  resistance gene
MFKLLSKLLVYLTASIMAIASPLAFSVDSSGEYPTVSEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSTRRLAEVEGNEIPTHSLEGLSSSGDAVRFGPVELFYPGAAHSTDNLVVYVPSASVLYGGCAIYELSLTSAGNVADADLAEWPTSIERIQQHYPEAQFVIPGHGLPGGLDLLKHTTNVVKAHTNRSVVE

SEQ ID NO: 306 - protein, 266 aa, Unknown
  resistance gene
MLKVISSLLVYMTASVMAVASPLAHSGEPSGEYPTVNEIPVGEVRLYQIADGVWSHIATQSFDGAVYPSNGLIVRDGDELLLIDTAWGAKNTAALLAEIEKQIGLPVTRAVSTHFHDDRVGGVDVLRKAGVATYASPSTRRLAEAEGNEIPTHSLEGLSSSGDAVRFGPVELFYPGAAHSTDNLVVYVPSANVLYGGCAVLALSRTSAGNVADADLAEWPTSVERIQKHYPEAQFVIPGHGLPGGLDLLKHTTNVVKAHTNRSVVE

SEQ ID NO: 307 - protein, 266 aa, Unknown
  resistance gene
MLKVISSLLVYMTASVMAVASPLAHSGEPSGEYPTVNEIPVGEVRLYQIADGVWSHISTQSFDGAVYPSNGLIVRDGDELLLIDTAWGAKNTAALLAEIEKQIGLPVTRAVSTHFHDDRVGGVDVLRAAGVATYASPSTRRLAEAEGNEIPTHSLEGLSSSGDAVRFGPVELFYPGAAHSTDNLVVYVPSANVLYGGCAVHELSSTSAGNVADADLAEWPTSVERIQKHYPEAEVVIPGHGLPGGLDLLQHTANVVKAHKNRSVAE

SEQ ID NO: 308 - protein, 266 aa, Unknown
  resistance gene
MLKVISSLLVYMTASVMAVASPLAHSGEPSGEYPTVNEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSTRRLAEAEGNEIPTHSLEGLSSSGDAVRFGPVELFYPGAAHSTDNLVVYVPSANVLYGGCAVLELSRTSAGNVADADLAEWPTSVERIQKHYPEAEVVIPGHGLPGGLDLLQHTANVVKAHKNRSVAE

SEQ ID NO: 309 - protein, 266 aa, Unknown
  resistance gene
MFKLLSKLLVYLTASIMAIASPLAFSVDSSGEYPTVNEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSTRRLAEVEGNEIPTHSLEGLSSSGDAVRFGPVELFYPGAAHSTDNLVVYVPSASVLYGGCAIYELSRTSAGNVADADLAEWPTSIERIQQHYPEAQFVIPGHGLPGGLDLLKHTTNVVKAHTNRSVVE

SEQ ID NO: 310 - protein, 266 aa, Unknown
  resistance gene
MLKVISSLLVYMTASVMAVASPLAHSGEPSGEYPTVNEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSTRRLAEAEGNEIPTHSLEGLSSSGDAVRFGPVELFYPGAAHSTDNLVVYVPSANVLYGGCAVHELSSTSAGNVADADLAEWPTSVERIQKHYPEAEVVIPGHGLPGGLDLLQHTANVVKAHKNRSVAE

SEQ ID NO: 311 - protein, 265 aa, Unknown
  resistance gene
MFQIRSFLVGISAFVMAVLGSAAYSAQPGGEYPTVDDIPVGEVRLYKIGDGVWSHIATQKLGDTVYSSNGLIVRDADELLLIDTAWGAKNTVALLAEIEKQIGLPVTRSISTHFHDDRVGGVDVLRAAGVATYTSPLTRQLAEAAGNEVPAHSLKALSSSGDVVRFGPVEVFYPGAAHSGDNLVVYVPAVRVLFGGCAVHEASRESAGNVADANLAEWPATIKRIQQRYPEAEVVIPGHGLPGGLELLQHTTNVVKTHKVRPVAE

SEQ ID NO: 312 - protein, 262 aa, Unknown
  resistance gene
MFKLLSKLLVYLTASIMAIASPLAFSVDSSGEYPTVSEIPVGEVRLYQIADGVWSHIATRSFDGAVYPSNGLIVRDGDELLLIDTAWGAKNTAALLAEIEKQIGLPVTRAVSTHFHDDRVGGVDVLRAAGVATYASPSTRRLANEIPTHSLEGLSSSGDAVRFGPVELFYPGAAHSTDNLVVYVPSASVLYGGCAIYELSRTSAGNVADADLAEWPTSIERIQQHYPEAQFVIPGHGLPGGLDLLKHTTNVVKAHTNRSVVE

SEQ ID NO: 313 - protein, 266 aa, Unknown
  resistance gene
MLKVISSLLVYMTASVMAVASPLAHSGEPSGEYPTVNEIPVGEVRLYQIADGVWSHIATQSFDGAVYPSNGLIVRDGDELLLIDTAWGAKNTAALLAEIEKQIGLPVTRAVSTHFHDDRVGGVDVLRAAGVATYASPSTRRLAEAEGNEIPTHSLEGLSSSGDAVRFGPVELFYPGAAHSTDNLVVYVPSANVLYGGCAVLELSSTSAGNVADADLAEWPTSVERIQKHYPEAEVVIPGHGLPGGLDLLQHTANVVKAHKNRSVAE

SEQ ID NO: 314 - protein, 13 aa, Unknown
  resistance gene
AAGVATYASPSAR

SEQ ID NO: 315 - protein, 13 aa, Unknown
  resistance gene
AAGVATYASPSIR

SEQ ID NO: 316 - protein, 13 aa, Unknown
  resistance gene
AAGVATYASPSTR

SEQ ID NO: 317 - protein, 13 aa, Unknown
  resistance gene
AAGVATYTSPLTR

SEQ ID NO: 318 - protein, 12 aa, Unknown
  resistance gene
AGVATYASPSTR

SEQ ID NO: 319 - protein, 5 aa, Unknown
  resistance gene
AHTNR

SEQ ID NO: 320 - protein, 10 aa, Unknown
  resistance gene
ALSSSGDVVR

SEQ ID NO: 321 - protein, 10 aa, Unknown
  resistance gene
AVSTHFHDDR

SEQ ID NO: 322 - protein, 15 aa, Unknown
  resistance gene
DADELLLIDTAWGAK

SEQ ID NO: 323 - protein, 15 aa, Unknown
  resistance gene
DGDELLLIDTAWGAK

SEQ ID NO: 324 - protein, 15 aa, Unknown
  resistance gene
DGDELLLIDTAWGTK

SEQ ID NO: 325 - protein, 19 aa, Unknown
  resistance gene
ESAGNVADANLAEWPATIK

SEQ ID NO: 326 - protein, 15 aa, Unknown
  resistance gene
GEYPTVSEIPVGEVR

SEQ ID NO: 327 - protein, 7 aa, Unknown
  resistance gene
HTTNVVK

SEQ ID NO: 328 - protein, 13 aa, Unknown
  resistance gene
IGDGVWSHIATQK

SEQ ID NO: 329 - protein, 21 aa, Unknown
  resistance gene
LANEIPTHSLEGLSSSGDAVR

SEQ ID NO: 330 - protein, 14 aa, Unknown
  resistance gene
LGDTVYSSNGLIVR

SEQ ID NO: 331 - protein, 15 aa, Unknown
  resistance gene
LYQIADGVWSHIATK

SEQ ID NO: 332 - protein, 15 aa, Unknown
  resistance gene
LYQIADGVWSHIATR

SEQ ID NO: 333 - protein, 11 aa, Unknown
  resistance gene
NTAALLAEIEK

SEQ ID NO: 334 - protein, 11 aa, Unknown
  resistance gene
NTVALLAEIEK

SEQ ID NO: 335 - protein, 8 aa, Unknown
  resistance gene
QIGLPVTR

SEQ ID NO: 336 - protein, 16 aa, Unknown
  resistance gene
QLAEAAGNEVPAHSLK

SEQ ID NO: 337 - protein, 15 aa, Unknown
  resistance gene
SFDGAVYPSNGLIVR

SEQ ID NO: 338 - protein, 10 aa, Unknown
  resistance gene
SISTHFHDDR

SEQ ID NO: 339 - protein, 10 aa, Unknown
  resistance gene
SVSTHFHDDR

SEQ ID NO: 340 - protein, 20 aa, Unknown
  resistance gene
TSAGNVADADLAEWPGSVER

SEQ ID NO: 341 - protein, 20 aa, Unknown
  resistance gene
TSAGNVADADLAEWPTSIER

SEQ ID NO: 342 - protein, 20 aa, Unknown
  resistance gene
TSAGNVADADLAEWPTSVER

SEQ ID NO: 343 - protein, 8 aa, Unknown
  resistance gene
VGGVDALR

SEQ ID NO: 344 - protein, 8 aa, Unknown
  resistance gene
VGGVDVLR

SEQ ID NO: 345 - protein, 13 aa, Unknown
  resistance gene
VLFGGCAVHEASR

SEQ ID NO: 346 - protein, 13 aa, Unknown
  resistance gene
VLYGGCAVHELSR

SEQ ID NO: 347 - protein, 264 aa, Unknown
  resistance gene
MSRLLLSGLLATGLLCAVPASAASGCFLYADGNGQTLSSEGDCSSQLPPASTFKIPLALMGYDSGFLVNEEHPALPYKPSYDGWLPAWRETTTPRRWETYSVVWFSQQITEWLGMERFQQYVDRFDYGNRDLSGNPGKHDGLTQAWLSSSLAISPEEQARFLGKMVSGKLPVSAQTLQYTANILKVSEVEGWQIHGKTGMGYPKKLDGSLNRDQQIGWFVGWASKPGKQLIFVHTVVQKPGKQFASIKAKEEVLAALPAQLKKL

SEQ ID NO: 348 - protein, 257 aa, Unknown
  resistance gene
IACLSSTALAGSITENTSWNKEFSAEAVNGVFVLCKSSSKSCATNDLARASKEYLPASTFKIPNAIIGLETGVIKNEHQVFKWDGKPRAMKQWERDLTLRGAIQVSAVPVFQQIAREVGEVRMQKYLKKFSYGNQNISGGIDKFWLEDQLRISAVNQVEFLESLYLNKLSASKENQLIVKEALVTEAAPEYLVHSKTGFSGVGTESNPGVAWWVGWVEKETEVYFFAFNMDIDNESKLPLRKSIPTKIMESEGIIGG

SEQ ID NO: 349 - protein, 274 aa, Unknown
  resistance gene
MKKILLLHMLVFVSATLPISSVASDEVETLKCTIIADAITGNTLYETGECARRVSPCSSFKLPLAIMGFDSGILQSPKSPTWELKPEYNPSPRDRTYKQVYPALWQSDSVVWFSQQLTSRLGVDRFTEYVKKFEYGNQDVSGDSGKHNGLTQSWLMSSLTISPKEQIQFLLRFVAHKLPVSEAAYDMAYATIPQYQAAEGWAVHGKSGSGWLRDNNGKINESRPQGWFVGWAEKNGRQVVFARLEIGKEKSDIPGGSKAREDILVELPVLMGNK

SEQ ID NO: 350 - protein, 275 aa, Unknown
  resistance gene
MAIRIFAILFSIFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGNAGPSTSNGDYWIEGSLAISAQEQIAFLRKLYRNELPFRVEHQRLVKDLMIVEAGRNWILRAKTGWEGRMGWWVGWVEWPTGSVFFALNIDTPNRMDDLFKREAIVRAILRSIEALPPNPAVNSDAAR

SEQ ID NO: 351 - protein, 275 aa, Unknown
  resistance gene
MQRSLSMSGKRHFIFAVSFVISTVCLTFSPANAAQKLSCTLVIDEASGDLLHREGSCDKAFAPMSTFKLPLAIMGYDADILLDATTPRWDYKPEFNGYKSQQKPTDPTIWLKDSIVWYSQELTRRLGESRFSDYVQRFDYGNKDVSGDPGKHNGLTHAWLASSLKISPEEQVRFLRRFLRGELPVSEDALEMTKAVVPHFEAGDWDVQGKTGTGSLSDAKGGKAPIGWFIGWATRDDRRVVFARLTVGARKGEQPAGPAARDEFLNTLPALSENF

SEQ ID NO: 352 - protein, 266 aa, Unknown
  resistance gene
MKTFAAYVIIACLSSTALAGSITENTSWNKEFSAEAVNGVFVLCKSSSKSCATNDLARASKEYLPASTFKIPNAIIGLETGVIKNEHQVFKWDGKPRAMKQWERDLTLRGAIQVSAVPVFQQIAREVGEVRMQKYLKKFSYGNQNISGGIDKFWLEGQLRISAVNQVEFLESLYLNKLSASKENQLIVKEALVTEAAPEYLVHSKTGFSGVGTESNPGVAWWVGWVEKETEVYFFAFNMDIDNESKLPLRKSIPTKIMESEGIIGG

SEQ ID NO: 353 - protein, 257 aa, Unknown
  resistance gene
IACLSSTALAGSITENTSWNKEFSAEAVNGVFVLCKSSSKSCATNDLARASKEYLPASTFKIPNAIIGLETGVIKNEHQVFKWDGKPRAMKQWERDLTLRGAIQVSAVPVFQQITREVGEVRMQKYLKKFSYGNQNISGGIDKFWLEDQLRISAVNQVEFLESLYLNKLSASKENQLIVKEALVTEAAPEYLVHSKTGFSGVGTESNPGVAWWVGWVEKETEVYFFAFNMDIDNESKLPLRKSIPTKIMESEGIIGG

SEQ ID NO: 354 - protein, 257 aa, Unknown
  resistance gene
IACLSSTALAGSITENTSWNKEFSAEAVNGVFVLCKSSSKSCATNDLARASKEYLPASTFKIPSAIIGLETGVIKNEHQVFKWDGKPRAMKQWERDLTLRGAIQVSAVPVFQQIAREVGEVRMQKYLKKFSYGNQNISGGIDKFWLEGQLRISAVNQVEFLESLYLNKLSASKENQLIVKEALVTEAAPEYLVHSKTGFSGVGTESNPGVAWWVGWVEKETEVYFFAFNMDIDNESKLPLRKSIPTKIMESEGIIGG

SEQ ID NO: 355 - protein, 266 aa, Unknown
  resistance gene
MIIRFLALLFSAVVLVSLGHAQEKTHESSNWGKYFSDFNAKGTIVVVDERTNGNSTSVYNESRAQQRYSPASTFKIPHTLFALDAGAVRDEFHVFRWDGAKRSFAGHNQDQNLRSAMRNSTVWVYQLFAKEIGENKARSYLEKLNYGNADPSTKSGDYWIDGNLAISANEQISILKKLYRNELPFRVEHQRLVKDLMIVEAKRDWILRAKTGWDGQMGWWVGWVEWPTGPVFFALNIDTPNRMEDLHKREAIARAILQSVNALPPN

SEQ ID NO: 356 - protein, 275 aa, Unknown
  resistance gene
MAIRIFAILFSTFVFGTFAHAQEGMRERSDWRKFFSEFQAKGTIVVADERQTDRVILVFDQVRSEKRYSPASTFKIPHTLFALDAGAARDEFQVFRWDGIKRSFAAHNQDQDLRSAMRNSTVWIYELFAKEIGEDKARRYLKQIDYGNADPSTSNGDYWIDGNLAIAAQEQIAFLRKLYHNELPFRVEHQRLVKDLMIVEAGRNWILRAKTGWEGRIGWWVGWVEWPTGPVFFALNIDTPNRMDDLFKREAIVRAILRSIEALPPNPAVNSDAAR

SEQ ID NO: 357 - protein, 266 aa, Unknown
  resistance gene
MKTFAAYVITACLSSTALASSITENTSWNKEFSAEAVNGVFVLCKSSSKSCATNNLARASKEYLPASTFKIPSAIIGLETGVIKNEHQVFKWDGKPRAMKQWERDLSLRGAIQVSAVPVFQQIAREVGEVRMQKYLKKFSYGNQNISGGIDKFWLEGQLRISAVNQVEFLESLFLNKLSASKENQLIVKEALVTEAAPEYLVHSKTGFSGVGTESNPGVAWWVGWVEKGTEVYFFAFNMDIDNENKLPLRKSIPTKIMASEGIIGG

SEQ ID NO: 358 - protein, 266 aa, Unknown
  resistance gene
MKTFAAYVITACLSSTALASSITENTSWNKEFSAEAVNGVFVLCKSSSKSCATNNLARASKEYLPASTFKIPNAIIGLETGVIKNEHQVFKWDGKPRAMKQWERDLSLRGAIQVSAVPVFQQIAREVGEVRMQKYLKKFSYGNQNISGGIDKFWLEDQLRISAVNQVEFLESLFLNKLSASKENQLIVKEALVTEAAPEYLVHSKTGFSGVGTESNPGVAWWVGWVEKGTEVYFFAFNMDIDNENKLPLRKSIPTKIMASEGIIGG

SEQ ID NO: 359 - protein, 266 aa, Unknown
  resistance gene
MKTFAAYVITACLSSTALASSITENTSWNKEFSAEAVNGVFVLCKSSSKSCATNNLARASKEYLPASTFKIPNAIIGLETGVIKNEHQVFKWDGKPRAMKQWERDLSLRGAIQVSAVPVFQQIAREVGEVRMQKYLKKFSYGNQNISGGIDKFGLEGQLRISAVNQVEFLESLFLNKLSASKENQLIVKEALVTEAAPEYLVHSKTGFSGVGTESNPGVAWWVGWVEKGTEVYFFAFNMDIDNENKLPLRKSIPTKIMASEGIIGG

SEQ ID NO: 360 - protein, 276 aa, Unknown
  resistance gene
MKNTIHINFAIFLIIANIIYSSASASTDISTVASPLFEGTEGCFLLYDASTNAEIAQFNKAKCATQMAPDSTFKIALSLMAFDAEIIDQKTIFKWDKTPKGMEIWNSNHTPKTWMQFSVVWVSQEITQKIGLNKIKNYLKDFDYGNQDFSGDKERNNGLTEAWLESSLKISPEEQIQFLRKIINHNLPVKNSAIENTIENMYLQDLDNSTKLYGKTGAGFTANRTLQNGWFEGFIISKSGHKYVFVSALTGNLGSNLTSSIKAKKNAITILNTLNL

SEQ ID NO: 361 - protein, 256 aa, Unknown
  resistance gene
ANIIYSSASASTDISTVASPLFEGTEGCFLLYDVSTNAEIAQFNKAKCATQMAPDSTFKIALSLMAFDAEIIDQKTIFKWDKTPKGMEIWNSNHTPKTWMQFSVVWVSQEITQKIGLNKIKNYLKDFDYGNQDFSGDKERNNGLTEAWLESSLKISPEEQIQFLRKIINHNLPVKNSAIENTIENMYLQDLENSTKLYGKTGAGFTANRTLQNGWFEGFIISKSGHKYVFVSALTGNLGSNLTSSIKAKKNAITIL

SEQ ID NO: 362 - protein, 246 aa, Unknown
  resistance gene
IFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGNAYPSTSNGDYWIEGSLAISAQEQIAFLRKLYRNELPFRVEHQRLVKDLMIVEAGRNWILRAKTGWEGRMGWWVGWVEWPTGSVFFALNIDTPNRMDDLFKREAIVRAIL

SEQ ID NO: 363 - protein, 266 aa, Unknown
  resistance gene
MIIRFLALLFSAVVLVSLGHAQDKTHESSNWGKYFSDFNAKGTIVVVDERTNGNSTSVYNESRAQQRYSPASTFKIPHTLFALDAGAVRDEFHVFRWDGAKRSFAGHNQDQNLRSAMRNSTVWVYQLFAKEIGENKARSYLEKLNYGNADPSTKSGDYWIDGNLAISANEQISILKKLYRNELPFRVEHQRLVKDLMIVEAKRDWILRAKTGWDGQMGWWVGWVEWPTGPVFFALNIDTPNRMEDLHKREAIARAILQSVNALPPN

SEQ ID NO: 364 - protein, 275 aa, Unknown
  resistance gene
MKKFILPIFSISILVSLSACSSIKTKSEDNFHISSQQHEKAIKSYFDEAQTQGVIIIKEGKNLSTYGNALARANKEYVPASTFKMLNALIGLENHKATTNEIFKWDGKKRTYPMWEKDMTLGEAMALSAVPVYQELARRTGLELMQKEVKRVNFGNTNIGTQVDNFWLVGPLKITPVQEVNFADDLAHNRLPFKLETQEEVEKMLLIKEVNGSKIYAKSGWGMGVTPQVGWLTGWVEQANGKKIPFSLNLEMKEGMSGSIRNEITYKLLENLGII

SEQ ID NO: 365 - protein, 275 aa, Unknown
  resistance gene
MKKFILPIFSISILVSLSACSSIKTKSEDNFHISSQQHEKAIKSYFDEAQTQGVIIIKEGKNLSTYGNALARANKEYVPASTFKMLNALIGLENHKATTNEIFKWDGKKRTYPMWEKDMTLGEAMALSAVPVYQELARRTGLELMQKEVKRVNFGNTNIGTQVDNFWLVGPLKITPVQEVNFADDLAHNRLPFKLETQEEVKKMLLIKEVNGSKIYAKSGWGMGVTPQVGWLTGWVEQANGKKIPFSLNLEMKEGMTGSIRNEITYKSLENLGII

SEQ ID NO: 366 - protein, 273 aa, Unknown
  resistance gene
MNKYFTCYVVASLFLSGCTVQHNLINETPSQIVQGHNQVIHQYFDEKNTSGVLVIQTDKKINLYGNALSRANTEYVPASTFKMLNALIGLENQKADINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLTGWVEQPDGKIVAFALKMEMRSEMPASIRNELLMKSLKQLNII

SEQ ID NO: 367 - protein, 257 aa, Unknown
  resistance gene
MAIRIFAILFSIFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGNADPSTSNGDYCIEGSLAISAQEQIAFLRKLYRNELPFRVEHQRLVKDLMIVEAGRNWILRAKTGWEGRMGWWVGWVEWPTGSVFFALNIDTPNRMDDLFKREAIVRAIL

SEQ ID NO: 368 - protein, 266 aa, Unknown
  resistance gene
MKTFAAYVITACLSSTALASSITENTSWNKEFSAEAVNGVFVLCKSSSKSCATNNLARASKEYLPASTFKIPNAIIGLETGVIKNEHQVFKWDGKPRAMKQWERDLSLRGAIQVSAVPVFQQIAREVGEVRMQKYLKKFSYGNQNISGGIDKFWLEGQLRISAVNQVEFLESLFLNKLSASKENQLIVKEALVTEAAPEYLVHSKTGFSGVGTESNPGVAWWVGWVEKGTEVYFFAFNMDIDNENKLPLRKSIPTKIMASEGIIGG

SEQ ID NO: 369 - protein, 266 aa, Unknown
  resistance gene
MAIRFLTILLSTFFLTSFVHAQEHVLERSDWKKFFSDLRAEGAIVISDERQAEHALLVFGQERAAKRYSPASTFKLPHTLFALDADAVRDEFQVFRWDGVKRSFAGHNQDQDLRSAMRNSAVWVYELFAKEIGKDKARHYLKQIDYGNADPSTIKGDYWIDGNLEISAHEQISFLRKLYRNQLPFQVEHQRLVKDLMITEAGRNWILRAKTGWEGRFGWWVGWVEWPTGPVFFALNIDTPNRTDDLFKREAIARAILRSIDALPPN

SEQ ID NO: 370 - protein, 275 aa, Unknown
  resistance gene
MAIRIFAILFSIFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGNADPSTSNGDYWIEGSIAISAQEQIAFLRKLYRNELPFRVEHQRLVKDLMIVEAGRNWILRAKTGWEGRMGWWVGWVEWPTGSVFFALNIDTPNRMDDLFKREAIVRAILRSIEALPPNPAVNSDAAR

SEQ ID NO: 371 - protein, 275 aa, Unknown
  resistance gene
MKKFILPIFSISILVSLSACSSIKTKSEDNFHISSQQHEKAIKSYFDEAQTQGVIIIKEGKNLSTYGNALARANKEYVPASTFKMLNALIGLENHKATTNEIFKWDGKKRTYPMWEKDMTLGEAMALSAVPVYQELARRTGLELMQKEVKRVNFGNTNIGTQVDNFWLVGPLKITPVQEVNFADDLAHNRLPFKLETQEEVKKMLLIKEVNGSKIYAKSGWGMGVTPQVGWLTGWVEQANGKKIPFSLNLEMKEGMSGSIRNEITYKSLENLGII

SEQ ID NO: 372 - protein, 266 aa, Unknown
  resistance gene
MAIRFLTILLSTFFLTSFVHAQEHVLERSDWKKFFSDLRAEGAIVISDERQAEHALLVFGQERAAKRYSPASTFKLPHTLFALDADAVRDEFQVFRWDGVKRSFAGHNQDQDLRSAMRNSAVWVYELFAKEIGEDKARRYLKQIDYGNADPSTIKGDYWIDGNLEISAHEQISFLRKLYRNQLPFQVEHQRLVKDLMITEAGRNWILRAKTGWEGRFGWWVGWVEWPTGPVFFALNIDTPNRTDDLFKREAIARAILRSIDALPPN

SEQ ID NO: 373 - protein, 266 aa, Unknown
  resistance gene
MAIRFFTILLSTFFLTSFVYAQEHVVIRSDWKKFFSDLQAEGAIVIADERQAKHTLSVFDQERAAKRYSPASTFKIPHTLFALDADAVRDEFQVFRWDGVNRSFAGHNQDQDLRSAMRNSTVWVYELFAKDIGEDKARRYLKQIDYGNVDPSTIKGDYWIDGNLKISAHEQILFLRKLYRNQLPFKVEHQRLVKDLMITEAGRSWILRAKTGWEGRFGWWVGWIEWPTGPVFFALNIDTPNRTDDLFKREAIARAILRSIDALPPN

SEQ ID NO: 374 - protein, 274 aa, Unknown
  resistance gene
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVERIGFGNAEIGQQVDNFWLVGPLKVTPIQEVEFVSQLAHTQLPFSEKVQANVKNMLLLEESNGYKIFGKTGWAAMDIKPQVGWLTGWVEQPDGKIVAFALNMEMRSEMPASIRNELLMKSLKQLNII

SEQ ID NO: 375 - protein, 275 aa, Unknown
  resistance gene
MAIQIFAILFSTFVLATFAHAQDGTLERSDWGKFFSDFQAKGTIVVADERQADHAILVFDQARSMKRYSPASTFKIPHTLFALDAGAVRDEFQIFRWDGVKRSFAGHNKDQDLRSAMRNSTVWVYELFAKEIGDGKARRYLKQIGYGNADPSTSHGDYWIEGSLAISAQEQIAFLRKLYQNDLPFRVEHQRLVKDLMIVEAGRNWILRAKTGWEGSMGWWVGWVEWPTGPVFFALNIDTPNRMDDLFKREAIARAILLSIEALPPNPAVHSDAAR

SEQ ID NO: 376 - protein, 276 aa, Unknown
  resistance gene
MKNTIHINFAIFLIIANIIYSSASASTDISTVASQLFEGTEGCFLLYDASTNAEIAQFNKAKCAAQMAPDSTFKIALSLMAFDAEIIDQKTIFKWDKIPKGMEIWNSNHTPKTWMQFSVVWVSQEITQKIGLNKIKNYLKDFDYGNQDFSGDKERNNGLTEAWLESSLKISPEEQIQFLRKIINHNLPVRNSAIENTIDNMYLQDLENSTKLYGKTGAGFTANRTLQNGWFEGFIISKSGHKYVFVSALTGSLGSNLTSSIKAKKNAITILNTLNL

SEQ ID NO: 377 - protein, 254 aa, Unknown
  resistance gene
MLLFMFSIISFGNENQFMKEIFERKGLNGTFVVYDLKNDKIDYYNLDRANERFYPASSFKIFNTLIGLENGIVKNVDEMFYYYDGSKVFLDSWAKDSNLRYAIKVSQVPAYKKLARELGKERMQEGLNKLNYGNKEIGSEIDKFWLEGPLKISAMEQVKLLNLLSQSKLPFKLENQEQVKDITILEKKDDFILHGKTGWATDNIVVPIGWFVGWIETSDNIYSFAINLDISDSKFLPKREEIVREYFKNINVIK

SEQ ID NO: 378 - protein, 265 aa, Unknown
  resistance gene
MRVLALSAVFLVASIIGMPAVAKEWQENKSWNAHFTEHKSQGVVVLWNENKQQGFTNNLKRANQAFLPASTFKIPNSLIALDLGVVKDEHQVFKWDGQTRDIATWNRDHNLITAMKYSVVPVYQEFARQIGEARMSKMLHAFDYGNEDISGNVDSFWLDGGIRISATEQISFLRKLYHNKLHVSERSQRIVKQAMLTEANGDYIIRAKTGYSTRIEPKIGWWVGWVELDDNVWFFAMNMDMPTSDGLGLRQAITKEVLKQEKIIP

SEQ ID NO: 379 - protein, 271 aa, Unknown
  resistance gene
MLSRYSKTLAFAVVACTLAISTATAHAELVVRNDLKRVFDDAGVSGTFVLMDITADRTYVVDPARAARSIHPASTFKIPNSLIAFDTGAVRDDQEVLPYGGKPQPYEQWEHDMALPEAIRLSAVPIYQEVARRVGFERMQAYVDAFDYGNRQLGSAIDQFWLRGPLEISAFEEARFTSRMALKQLPVKPRTWDMVQRMLLIEQQGDAALYAKTGVATEYQPEIGWWAGWVERAGHVYAFALNIDMPREGDMAKRIPLGKQLMRALEVWPAP

SEQ ID NO: 380 - protein, 262 aa, Unknown
  resistance gene
MRPLLFSALLLLSGHTQASEWNDSQAVDKLFGAAGVKGTFVLYDVQRQRYVGHDRERAETRFVPASTYKVANSLIGLSTGAVRSADEVLPYGGKPQRFKAWEHDMSLRDAIKASNVPVYQELARRIGLERMRANVSRLGYGNAEIGQVVDNFWLVGPLKISAMEQTRFLLRLAQGELPFPAPVQSTVRAMTLLESGPGWELHGKTGWCFDCTPELGWWVGWVKRNERLYGFALNIDMPGGEADIGKRVELGKASLKALGILP

SEQ ID NO: 381 - protein, 289 aa, Unknown
  resistance gene
MNKGLHRKRLSKRLLLPMLLCLLAQQTQAVAAEQTKVSDVCSEVTAEGWQEVRRWDKLFESAGVKGSLLLWDQKRSLGLSNNLSRAAEGFIPASTFKLPSSLIALETGAVRDETSRFSWDGKVREIAVWNRDQSFRTAMKYSVVPVYQQLAREIGPKVMAAMVRQLEYGNQDIGGQADSFWLDGQLRITAFQQVDFLRQLHDNKLPVSERSQRIVKQMMLTEASTDYIIRAKTGYGVRRTPAIGWWVGWLELDDNTVYFAVNLDLASASQLPLRQQLVKQVLKQEQLLP

SEQ ID NO: 382 - protein, 285 aa, Unknown
  resistance gene
MNTIISRRWRAGLWRRLVGAVVLPATLAATPAAYAADVPKAALGRITERADWGKLFAAEGVKGTIVVLDARTQTYQAYDAARAEKRMSPASTYKIFNSLLALDSGALDNERAIIPWDGKPRRIKNWNAAMDLRTAFRVSCLPCYQVVSHKIGRRYAQAKLNEVGYGNRTIGGAPDAYWVDDSLQISAREQVDFVQRLARGTLPFSARSQDIVRQMSIVEATPDYVLHGKTGWFVDKKPDIGWWVGWIERDGNITSVAINIDMLSEADAPKRARIVKAVLKDLKLI

SEQ ID NO: 383 - protein, 266 aa, Unknown
  resistance gene
MKTFAAYVITACLSSTALASSITENTFWNKEFSAEAVNGVFVLCKSSSKSCATNNLARASKEYLPASTFKIPNAIIGLETGVIKNEHQIFKWDGKPRAMKQWERDLSLRGAIQVSAVPVFQQIAREVGEVRMQKYLKKFSYGNQNISGGIDKFWLEGQLRISAVNQVEFLESLFLNKLSASKENQLIVKEALVTEAAPEYLVHSKTGFSGVGTESNPGVAWWVGWVEKGAEVYFFAFNMDIDNENKLPLRKSIPTKIMASEGIIGG

SEQ ID NO: 384 - protein, 265 aa, Unknown
  resistance gene
MRVLALSAVLVVASIVGMPAMANEWQEKPSWNTHFSEHKAQGVIVLWNENKQQGFTNNLKRANQAFLPASTFKIPNSLIALDLGVVKDEHQVFKWDGQTRDIAAWNRDHDLITAMKYSVVPVYQEFARQIGQARMSKMLHAFDYGNEDISGNLDSFWLDGGIRISATEQVAFLRKLYHNKLHVSERSQRIVKQAMLTEANSDYIIRAKTGYSTRIEPQIGWWVGWVELDDNVWFFAMNMDMPTADGLGLRQAITKEVLKQEKIIP

SEQ ID NO: 385 - protein, 257 aa, Unknown
  resistance gene
MKKITLFLLFLNLVFGQDKILNNWFKEYNTSGTFVFYDGKTWASNDFSRAMETFSPASTFKIFNALIALDSGVIKTKKEIFYHYRGEKVFLSSWAQDMNLSSAIKYSNVLAFKEVARRIGIKTMQEYLNKLHYGNAKISKIDTFWLDNSLKISAKEQAILLFRLSQNSLPFSQEAMNSVKEMIYLKNMENLELFGKTGFNDGQKIAWIVGFVYLKDENKYKAFALNLDIDKFEDLYKREKILEKYLDELVKKVKNDG

SEQ ID NO: 386 - protein, 268 aa, Unknown
  resistance gene
MSKKNFILIFIFVILISCKNTEKISNETTLIDNIFTNSNAEGTLVIYNLNDDKYIIHNKERAEQRFYPASTFKIYNSLIGLNEKAVKDVDEVFYKLMAKSFLESWAKDSNLRYAIKNSQVPAYKELARRIGIKKMKENIEKLDFGNKSIGDSVDTFWLEGPLEISAMEQVKLLTKLAQNELQYPIEIQKAISDITITRANLHITLHGKTGLADSKNMTTEPIGWFVGWLEENDNIYVFALNIDNINSDDLAKRINIVKESLKALNLLK

SEQ ID NO: 387 - protein, 273 aa, Unknown
  resistance gene
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLTGWVEQPDGKIVAFALKMEMRSEMPASIRNELLMKSLKQLNII

SEQ ID NO: 388 - protein, 274 aa, Unknown
  resistance gene
MNIQALLLITSAIFISACSPYIVTANPNYSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRIGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGISSSVRKEITYRGLEQLGIL

SEQ ID NO: 389 - protein, 274 aa, Unknown
  resistance gene
MNIKALLLITSAIFISACSPYIVTANPNHSASKSDEKGEKIKNLFNEAHTTGVLVIQQGQTQQSYGNDLARASTEYVPASTFKMLNALIGLEHHKATTTEVFKWDGQKRLFPEWEKDMTLGDAMKASAIPVYQDLARRIGLELMSKEVKRVGYGNADIGTQVDNFWLVGPLKITPQQEAQFAYKLANKTLPFSPKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 390 - protein, 274 aa, Unknown
  resistance gene
MNIKALLLITSAIFISACSPYIVTANPNHSASKSDEKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 391 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 392 - protein, 274 aa, Unknown
  resistance gene
MNIKALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFAYKLANKTLPFSQEVQDEVQSMLFIEEKNGNKIYAKSGWGWDVNPQVGWLTGWVVQPQGNIVAFSLNLEMKKGIPSSVRKEITYKSLEQLGIL

SEQ ID NO: 393 - protein, 274 aa, Unknown
  resistance gene
MNIKALLLITSAIFISACSPYIVTANPNHSASKSDDKAEKIKNLFNEAHTTGVLVIHQGQTQQSYGNDLARASTEYVPASTFKMLNALIGLEHHKATTTEVFKWDGEKRLFPEWEKNMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 394 - protein, 274 aa, Unknown
  resistance gene
MNIKALLLITSAIFISACSPYIVTANPNHSASKSDKKAEKIKNLFNEAHTTGVLVIQQGQTQQSYGNDLARASTEYVPASTFKMLNALIGLEHHKATTTEVFKWNGQKRLFPEWEKDMTLGDAMKASAIPVYQDLARRIGLELMSNEVKRVGYGNADIGTQVDNFWLVGPLKITPQQEAQFAYKLANKTLPFSQKVQHEVQSMLFIEEKNGNKIYAKSGWGWDVDPQVGWLTGWVVQPQGNIVAFSLNLEMKKGIPSSVRKEITYKSLEQLGIL

SEQ ID NO: 395 - protein, 274 aa, Unknown
  resistance gene
MNIKALLLITSAIFISACSPYIVTANPNHSASKSDEKAEKIKNLFNEAHTTGVLVIQQGQTQQSYGNDLARASTEYVPASTFKMLNALIGLEHHKTTTTEVFKWDGQKRLFPEWEKDMTLGDAMKASAIPVYQDLARRIGLELMSKEVKRVGYGNADIGTQVDNFWLVGPLKITPQQEAQFAYKLANKTLPFSPKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 396 - protein, 274 aa, Unknown
  resistance gene
MNIKALLLITSAIFISACSPYIVSANPNHSASKSDEKAEKIKNLFNEAHTTGVLVIQQGQTQQSYGNDLARASTEYVPASTFKMLNALIGLEHHKATTTAVFKWDGQKRLFPEWEKNMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGTPSSVRKEITYKSLEQLGIL

SEQ ID NO: 397 - protein, 274 aa, Unknown
  resistance gene
MNIKALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLPRRIGLELMSNEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 398 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEKLGIL

SEQ ID NO: 399 - protein, 274 aa, Unknown
  resistance gene
MNIKTLLLITSTIFISACSPYIVTANPNHSTSKSDEKAEKIKNLFNEAHTTGVLVIQQGQTQQSYGNDLARASIEYVPASTFKMLNALIGLEHHKATTTEIFKWDGQKRLFPEWEKDMTLGDAMKASAIPVYQDLARRIGLELMSKEVKRVGYGNADIGTQVDNFWLVGPLKITPQQEAQFAYKLANKTLPFSLKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 400 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAISVYQDLARRIGLELMSKEVKRVGYGNADIGTQVDNFWLAGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 401 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASALPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 402 - protein, 274 aa, Unknown
  resistance gene
MNIKALLLITSAIFISACSPYIVTANPNHSASKSDDKAEKIKNLFNEAHTTGVLVIHQGQTQQSYGNDLARASTEYVPASTFKMLNALIGLEHHKATTTEVFKWDGEKRLFPEWEKNMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGSVVQPQGNIVAFSLNLEMKKGIPSSVRKEITYKSLEQLGIL

SEQ ID NO: 403 - protein, 274 aa, Unknown
  resistance gene
MNIKTLLLITSTIFISACSPYIVTANPNHSTSKSDEKAEKIKNLFNEAHTTGVLVIQQGQTQQSYGNDLARASIEYVPASTFKMLNALIGLEHHKATTTEIFKWDGQKRLFPEWEKDMTLGDAMKASAIPVYQDLARRIGLELMSKEVKRVGYGNADIGTQVDNFWLVGPLKITPQQEAQFAYKLANKTLPFSLKAQDEVQSMLFIEEKNGNKIYAKSGWGWDVDPQVGWLTGWVVQPQGNIVAFSLNLEMKKGIPSSVRKEITYKSLEQLGIL

SEQ ID NO: 404 - protein, 274 aa, Unknown
  resistance gene
MNIKALLLITSAIFISACSPYIVTANPNHSASKSDKKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 405 - protein, 274 aa, Unknown
  resistance gene
MNIKTLLLITSAIFISACSHYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFTYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 406 - protein, 274 aa, Unknown
  resistance gene
MNIKALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 407 - protein, 274 aa, Unknown
  resistance gene
MNIKALLLITSTIFISACSPYIVTANPNHSASKSDEKAEKIKNLFNEAHTTGVLVIQQGQTQQSYGNDLARASTEYVPASTFKMLNALISLEHHKATTTEVFKWDGQKRLFPEWEKDMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 408 - protein, 274 aa, Unknown
  resistance gene
MNIQALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPHGNIVAFSLNLEMKKGIPSSVRKEITYKSLEQLGIL

SEQ ID NO: 409 - protein, 274 aa, Unknown
  resistance gene
MNIKALFLITSAIFISACSPYIVTANPNHSASKSDEKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 410 - protein, 280 aa, Unknown
  resistance gene
MKLLKILSLVCLSISIGACAEHSMSRAKTSTIPQVNNSIIDQNVQALFNEISADAVFVTYDGQNIKKYGTHLDRAKTAYIPASTFKIANALIGLENHKATSTEIFKWDGKPRFFKAWDKDFTLGEAMQASTVPVYQELARRIGPSLMQSELQRIGYGNMQMGTEVDQFWLKGPLTITPIQEVKFVYDLAQGQLPFKPEVQQQVKEMLYVERRGENRLYAKSGWGMAVDPQVGWYVGFVEKADGQVVAFALNMQMKAGDDIALRKQLSLDVLDKLGVFHYL

SEQ ID NO: 411 - protein, 274 aa, Unknown
  resistance gene
MNIKALLLITSTIFISACSPYIVTANPNHSTSKSDEKAEKIKNLFNEAHTTGVLVIQQGQTQQSYGNDLARASTEYVPASTFKMLNALIGLEHHKATTTEIFKWDGQKRLFPEWEKDMTLGDAMKASAIPVYQDLARRIGLELMSKEVKRVGYGNADIGTQVDNFWLVGPLKITPQQEAQFAYKLANKTLPFSLKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 412 - protein, 274 aa, Unknown
  resistance gene
MNIKTLLLITSAIFISACSPYIVTANPNHSASKSDEKAEKIKNLFNEVHTTGVLVIRQGQTQQSYGNDLARASTEYVPASTFKMLNALIGLEHHKATTTEVFKWDGQKRLFPEWEKDMTLGDAMKASAIPVYQDLARRIGLELMSKEVKRVGYGNADIGTQVDNFWLVGPLKITPQQEAQFAYKLANKTLPFSPKVQDEVQSMLFIEEMNGNKIYAKSGWGWDVDPQVGWLTGWVVQPQGNIVAFSLNLEMKKGIPSSVRKEITYKSLEQLGIL

SEQ ID NO: 413 - protein, 280 aa, Unknown
  resistance gene
MKLLKILSLVCLSISIGACAEHSMSRAKTSTIPQVNNSIIDQNVQALFNEISGDAVFVTYDGQNIKKYGTHLDRAKTAYIPASTFKIANALIGLENHKATSTEIFKWDGKPRFFKAWDKDFTLGEAMQASTVPVYQELARRIGPSLMQSELQRIGYGNMQIGTEVDQFWLKGPLTITPIQEVKFVYDLAQGQLPFKPEVQQQVKEMLYVERRGENRLYAKSGWGMAVDPQVGWYVGFVEKADGQVVAFALNMQMKAGDDIALRKQLSLDVLDKLGVFHYL

SEQ ID NO: 414 - protein, 275 aa, Unknown
  resistance gene
MKKFILPIFSISILVSLSACSSIKTKSEDNFHISSQQHEKAIKSYFDEAQTQGVIIIKEGKNLSTYGNALARANKEYVPASTFKMLNALIGLENHKATTNEIFKWDGKKRTYPMWEKDMTLGEAMALSAVPVYQELARRTGLELMQKEVKRVNFGNTNIGTQVDNFWLVGPLKITPVQEVNFADDLAHNRLPFKLETQEEVKKMLLIKEVNGSKIYAKSGWGMDVTPQVGWLTGWVEQANGKKIPFSLNLEMKEGMSGSIRNEITYKSLENLGII

SEQ ID NO: 415 - protein, 275 aa, Unknown
  resistance gene
MAIRIFAILFSIFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGNADPSTSNGDYWIESSLAISAQEQIAFLRKLYRNELPFRVEHQRLVKDLMIVEAGRNWILRAKTGWEGRMGWWVGWVEWPTGSVFFALNIDTPNRMDDLFKREAIVRAILRSIEALPPNPAVNSDAAR

SEQ ID NO: 416 - protein, 274 aa, Unknown
  resistance gene
MNIKALLLITSAIFISACSPYIVTANPNHSASKSDEKAEKIKNLFNEAHTTGVLVIQQGQTQQSYGNDLARASTEYVPASTFKMLNALIGLEHHKATTTEVFKWDGKKRLFPEWEKNMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 417 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAILVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 418 - protein, 274 aa, Unknown
  resistance gene
MNIKALLLITSAIFISACSPYIVTANPNHSASKSDKKAEKIKNLFNEAHTTGVLVIQQGQTQQSYGNDLARASTEYVPASTFKMLNALIGLEHHKATTTEVFKWNGQKRLFPEWEKDMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 419 - protein, 274 aa, Unknown
  resistance gene
MNIKALLLITSAIFISACSPYIVTANPNHSASKSDDKAEKIKNLFNEAHTTGVLVIHQGQTQQSYGNDLARASTEYVPASTFKMLNALIGLEHHKATTTEVFKWDGEKRLFPEWEKNMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 420 - protein, 274 aa, Unknown
  resistance gene
MNIKALLLITSAIFISACSPYIVTTNPNHSASKSDEKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNTDIGTQVDNFWVVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 421 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIQVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 422 - protein, 274 aa, Unknown
  resistance gene
MNIKALLLITSAIFISACSPYIVTANPNHSASKSDDKAEKIKNLFNEAHTTGVLVIHQGQTQQSYGNDLARASTEYVPASTFKMLNALIGLEHHKATTTEVFKWDGEKRLFPEWEKNMTLGDAMKASALPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 423 - protein, 274 aa, Unknown
  resistance gene
MNIKTLLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKDMTLGDAMKASAIPVYQDLARRIGLELMSKEVKRVGYGNADIGTQVDNFWLVGPLKITPQQEAQFAYKLANKTLPFSPKVQDEVQSMLFIEEMNGNKIYAKSGWGWDVDPQVGWLTGWVVQPQGNIVAFSLNLEMKKGIPSSVRKEITYKSLEQLGIL

SEQ ID NO: 424 - protein, 274 aa, Unknown
  resistance gene
MNIKALLLITSAIFISACSPYIVTANPNHSASKSDDKAEKIKNLFNEAHTTGVLVIHQGQTQQSYGNDLARASTEYVPASTFKMLNALIGLEHHKATTTEVFKWDGEKRLFPEWEKNMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFPLNLEMKKGIPSSVRKEITYKSLEQLGIL

SEQ ID NO: 425 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGGDVNPQVGWLTGWVVQPQGNIVAFSLNLEMKKGIPSSVRKEITYKSLEQLGIL

SEQ ID NO: 426 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAILVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 427 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 428 - protein, 274 aa, Unknown
  resistance gene
MNIKALLLITSAIFISACSPYIVTANPNHSASKSDEKAEKIKNLFNEAHTTGVLVIQQGQTQQSYGNDLARASTEYVPASTFKMLNALIGLEHHKTTTTEVFKWDGQKRLFPEWEKDMTLGDAMKASAIPVYQDLARRIGLELMSKEVKRVGYGNADIGTQVDNFWVVGPLKITPQQEAQFAYKLANKTLPFSPKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 429 - protein, 269 aa, Unknown
  resistance gene
MSKKNFILIFIFVILISCKNTEKISNETTLIDNIFTNSNAEGTLVIYNLNDDKYIIHNKERAEQRFYPASTFKIYNSLIGLNEKAVKDVDEVFYKYNGEKVFLESWAKDSNLRYAIKNSQVPAYKELARRIGLKKMKENIEKLDFGNKSIGDSVDTFWLEGPLEISAMEQVKLLTKLAQNELPYPIEIQKAVSDITILEQTYNYTLHGKTGLADSKNMTTEPIGWFVGWLEENDNIYVFALNIDNINSDDLAKRINIVKESLKALNLLK

SEQ ID NO: 430 - protein, 269 aa, Unknown
  resistance gene
MSKKNFILIFIFVILTSCKNTEKISNETTLIDNIFTNSNAEGTLVIYNLNDDKYIIHNKERAEQRFYPASTFKIYNSLIGLNEKAVKDVDEVFYKYNGEKVFLESWAKDSNLRYAIKNSQVPAYKELARRIGLKKMKENIEKLDFGNKSIGDSVDTFWLEGPLEISAMEQIKLLTKLAQNELPYPIEIQKAVSDITILEQTYNYTLHGKTGLADSKNMTTEPIGWFVGWLEENDNIYVFALNIDNINSDDLAKRINIVKESLKALNLLK

SEQ ID NO: 431 - protein, 262 aa, Unknown
  resistance gene
LLITSAIFISACSPYIVSANPNHSASKSDDKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSL

SEQ ID NO: 432 - protein, 262 aa, Unknown
  resistance gene
LLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVNPQVGWLTEWVVQPQGNIVAFSLNLEMKKGIPSSVRKEITYKSL

SEQ ID NO: 433 - protein, 275 aa, Unknown
  resistance gene
MTVRRLSCALGAALSLSALGGGPVQAAVLCTVVADAADGRILFQQGTQQACAERYTPASTFKLAIALMGADAGILQGPHEPVWNYQPAYPDWGGDAWRQPTDPARWIKYSVVWYSQLTAKALGQDRFQRYTSAFGYGNADVSGEPGKHNGTDGAWIISSLRISPLEQLAFLRKLVNRQLPVKAAAYELAENLFEAGQADGWRLYGKTGTGSPGSNGVYTAANAYGWFVGWARKDGRQLVYARLLQDERATRPNAGLRARDELVRDWPAMAGAWRP

SEQ ID NO: 434 - protein, 274 aa, Unknown
  resistance gene
MNIKALLLITSAIFISACSPYIVSANPNHSASKSDEKAEKIKNLFNEAHTTGVLVIQQGQTQQSYGNVLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFAYKLANKTLPFSQEVQDEVQSMLFIEEKNGNKIYAKSGWGWDVNPQVGWLTGWVVQPQGNIVAFSLNLEMKKGIPSSVRKEITYKSLEQLGIL

SEQ ID NO: 435 - protein, 266 aa, Unknown
  resistance gene
MKTFAAYVIIACLSSTALAGSITENTSWNKEFSAEAVNGVFVLCKSSSKSCATNDLARASKEYLPASTFKIPSAIIGLETGVIKNEHQVFKWDGKPRAMKQWERDLTLRGAIQVSAVPVFQQIAREVGEVRMQKYLKKFSYGNQNISGGIDKFWLEDQLRISAVNQVEFLESLYLNKLSASKENQLIVKEALVTEAAPEYLVHSKTGFSGVGTESNPGVAWWVGWVEKETEVYFFAFNMDIDNESKLPLRKSIPTKIMESEGIIGG

SEQ ID NO: 436 - protein, 274 aa, Unknown
  resistance gene
MNIKTLLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 437 - protein, 274 aa, Unknown
  resistance gene
MNIKALLLITSAIFISACSPYIVTTNPNHSASKSDEKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNTDIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 438 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAVPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNQQVGWLTGWVVQPQGNIVAFSLNLEMKKGIPSSVRKEITYKSLEQLGIL

SEQ ID NO: 439 - protein, 274 aa, Unknown
  resistance gene
MNIKTLLLITSAIFISACSPYIVTANPNHSASKSDEKAEKIKNLFNEVHTTGVLVIQQGQTQQSYGNDLARASTEYVPASTFKMLNALIGLEHHKATTTEVFKWDGQKRLFPEWEKDMTLGDAMKASAIPVYQDLARRIGLELMSKEVKRVGYGNADIGTQVDNFWLVGPLKITPQQEAQFAYKLANKTLPFSPKVQDEVQSMLFIEEKNGNKIYAKSGWGWDVDPQVGWLTGWVVQPQGNIVAFSLNLEMKKGIPSSVRKEMTYKSLEQLGIL

SEQ ID NO: 440 - protein, 273 aa, Unknown
  resistance gene
MNKYFTCYVVASLFFSGCTVQHNLINETQSQIVQGHNQVIHQYFDEKNTSGVLVIQTDKKINLYGNALSRANTEYVPASTFKMLNALIGLENQKTDINEIFKWKGEKRSFTTWEKDMTLGEAMKLSAVPVYQELARRIGLDLMQKEVERIDFGNAEIGQQVDNFWLIGPLKVTPIQEVEFVSQLAHTQLPFSEKVQANVKNMLLLEENNGYKIFGKTGWAMDIKPQVGWLTGWVEQPDGKIVAFALNMEMRSEMPASIRNELLMKSLKQLNII

SEQ ID NO: 441 - protein, 274 aa, Unknown
  resistance gene
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAAMDIKPQVGWLTGWVEQPDGKIVAFALNMEMRSEMPASIRNELLMKSLKQLNII

SEQ ID NO: 442 - protein, 266 aa, Unknown
  resistance gene
MKTFAAYVITACLSSTALASSITENTSWNKEFSAEAVNGVFVLCKSSSKSCATNNLARASKEYLPASTFKIPNAIIGLETGVIKNEHQVFKWDGKPRAMKQWERDLSLRGAIQVSAVPVFQQIAREVGEVRMQKYLKKFSYGNQNISGGIDKFLLEGQLRISAVNQVEFLESLFLNKLSASKENQLIVKEALVTEAAPEYLVHSKTGFSGVGTESNPGVAWWVGWVEKGTEVYFFAFNMDIDNENKLPLRKSIPTKIMASEGIIGG

SEQ ID NO: 443 - protein, 275 aa, Unknown
  resistance gene
MAIRIFAILFSIFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGDADPSTSNGDYWIEGSLAISAQEQIAFLRKLYRNELPFRVEHQRLVKDLMIVEAGRNWILRAKTGWEGRMGWWVGWVEWPTGSVFFALNIDTPNRMDDLFKREAIVRAILRSIEALPPNPAVNSDAAR

SEQ ID NO: 444 - protein, 274 aa, Unknown
  resistance gene
MNIKALLLITSAIFISACSPYIVTANPNHSASKSDKKAEKIKNLFNEAHTTGVLVIQQGQTQQSYGNDLARASTEYVPASTFKMLNALIGLEHHKASTTEVFKWNGQKRLFPEWEKDMTLGDAMKASAIPVYQDLARRIGLELMSNEVKRVGYGNADIGTQVDNFWLVGPLKITPQQEAQFAYKLANKTLPFSQKVQDEVKSMLFIEEKNGNKIYAKSGWGWDVDPQVGWLTGWVVQPQGNIVAFSLNLEMKKGIPSSVRKEITYKSLEQLGIL

SEQ ID NO: 445 - protein, 274 aa, Unknown
  resistance gene
MNIKALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKHVGYGNADIGTQVDNFWLVGPLKITPQQEAQFAYKLANKTLPFSPKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 446 - protein, 274 aa, Unknown
  resistance gene
MNIKALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKHVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 447 - protein, 275 aa, Unknown
  resistance gene
MKKFILPILSISTLLSVSACSSIQTKFEDTFHTSNQQHEKAIKSYFDEAQTQGVIIIKKGKNISTYGNNLTRAHTEYVPASTFKMLNALIGLENHKATTTEIFKWDGKKRSYPMWEKDMTLGDAMALSAVPVYQELARRTGLDLMQKEVKRVGFGNMNIGTQVDNFWLVGPLKITPIQEVNFADDFANNRLPFKLETQEEVKKMLLIKEFNGSKIYAKSGWGMDVTPQVGWLTGWVEKSNGEKVAFSLNIEMKQGMPGSIRNEITYKSLENLGII

SEQ ID NO: 448 - protein, 274 aa, Unknown
  resistance gene
MNIKALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFAYKLANKTLPFSQEVQDEVQSILFIEEKNGNKIYAKSGWGWDVNPQVGWLTGWVVQPQGNIVAFSLNLEMKKGIPSSVRKEITYKSLEQLGIL

SEQ ID NO: 449 - protein, 275 aa, Unknown
  resistance gene
MKKFILPIFSISILVSLSACSSIKTKSEDNFHISSQQHEKAIKSYFDEAQTQGVIIIKEGKNLSTYGNALARANKEYVPASTFKMLNALIGLENHKATTNEIFKWDGKKRTYPMWEKDMTLGEAMALSAVPVYQELARRTGLELMQKEVKRVNFGNTNIGTQVDNFWLVGPLKITPVQEVNFADDLAHNRLPFKLETQEEVKKMLLIKEVNGSKIYAKSGWGMGVTSQVGWLTGWVEQANGKKIPFSLNLEMKEGMSGSIRNEITYKSLENLGII

SEQ ID NO: 450 - protein, 265 aa, Unknown
  resistance gene
MRVLALSAVFLVASIIGMPAVAKEWQENKSWNAHFTEHKSQGVVVLWNENKQQGFTNNLKRANQAFLPASTFKIPNSLIALDLGVVKDEHQVFKWDGQTRDIATWNRDHNLITAMKYSVVPVYQEFARQIGEARMSKMLHAFDYGNEDISGNVDSFWLDGGIRISATEQISFLRKLYHNKLHVSERSQRIVKQAMLTEANGDYIIRAKTGYSARIEPKIGWWVGWVELDDNVWFFAMNMDMPTSDGLGLRQAITKEVLKQEKIIP

SEQ ID NO: 451 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAVPVYQDLARRIGLELMSKEVKRVGYGNADIGTQVDNFWLVGPLKITPQQEAQFAYKLANKTLPFSQKVQDEVQSMLFIEEKNGNKIYAKSGWGLDVNPQVGWLTGWVVQPQGNIVAFSLNLEMKKGIPSSVRKEITYKSLEQLGIL

SEQ ID NO: 452 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAVPVYQDLARRIGLELMSKEVKRVGYGNADIGTQVDNFWLVGPLKITPQQEAQFAYKLANKTLPFSQKVQDEVQSMLFIEEKNGNKIYAKSGWGLDVNLQVGWLTGWVVQPQGNIVAFSLNLEMKKGIPSSVRKEITYKSLEQLGIL

SEQ ID NO: 453 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEKLGIL

SEQ ID NO: 454 - protein, 274 aa, Unknown
  resistance gene
MNIKALLLITSAIFISACSPYIVTANPNHSASKSDVKAEKIRNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 455 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDSKKRLFPEWEKDMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 456 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPFSQKVQDGVQSMLFIEEKNGNKIYAKSGWGWDVNPQVGWLTGWVVQPQGNIVAFSLNLEMKKGIPSSVRKEITYKSLEQLGIL

SEQ ID NO: 457 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDSKKRLFPEWEKDMTLGDAMKASAILVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 458 - protein, 280 aa, Unknown
  resistance gene
MKLLKILSLVCLSISIGACAEHSMSRAKTSTIPQVNNSIIDQNVQALFNEISADAVFVTYDGQNIKKYGTHLDRAKTAYIPASTFKIANALIGLENHKATSTEIFKWDGKPRFLKAWDKDFTLGEAMQASTVPVYQELARRIGPSLMQSELQRIGYGNMQIGTEVDQFWLKGPLTITPIQEVKFVYDLAQGQLPFKPEVQQQVKEMLYVERRGENRLYAKSGWGMAVDPQVGWYVGFVEKADGQVVAFALNMQMKAGDDIALRKQLSLDVLDKLGVFHYL

SEQ ID NO: 459 - protein, 273 aa, Unknown
  resistance gene
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDVKPQVGWLTGWVEQPDGKIVAFALNMEMRSEMPASIRNELLMKSLKQLNII

SEQ ID NO: 460 - protein, 273 aa, Unknown
  resistance gene
MNKYFTCYVVASLFLSGCTVQHNLINETPSQIVQGHNQVIHQYFDEKNTSGALVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLTGWVEQPDGKIVAFALNMEMRSEMPASIRNELLMKSLKQLNII

SEQ ID NO: 461 - protein, 273 aa, Unknown
  resistance gene
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLTGWVEQPDGKIVAFALNMEMRSEMPASIRNELMMKSLKQLNII

SEQ ID NO: 462 - protein, 273 aa, Unknown
  resistance gene
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLAGWVEQPDGKIVAFALNMEMRSEMPASIRNELLMKSLKQLNII

SEQ ID NO: 463 - protein, 273 aa, Unknown
  resistance gene
MNKYFTCYVVASLFLSGCTVQHNLINETPSQIVQGHNQVIHQYFDERNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLTGWVEQPDGKIVAFALNMEMRSEMPASIRNELLMKSLKQLNII

SEQ ID NO: 464 - protein, 273 aa, Unknown
  resistance gene
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEKSNGYKIFGKTGWAMDIKPQVGWLTGWVEQPDGKIVAFALNMEMRSEMPASIRNELLMKSLKQLNII

SEQ ID NO: 465 - protein, 273 aa, Unknown
  resistance gene
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLTGWVEQPDGKIVAFALNMEMRSEMPASTRNELLMKSLKQLNII

SEQ ID NO: 466 - protein, 275 aa, Unknown
  resistance gene
MKKFILPIFSISILLSLSACSSIQTKFEDTFHISNQKHEKAIKSYFDEAQTQGVIIIKEGKNISSYGNNLVRAHTEYVPASTFKMLNALIGLENHKATTNEIFKWDGKKRSYPMWEKDMTLGEAMALSAVPVYQDLARRIGLNLMQKEVKRVGFGNMNIGTQVDNFWLIGPLKITPIQEVNFADDLANNRLPFKLETQEEVKKMLLIKEVNGSKIYAKSGWGMDVSPQVGWLTGWVEKSNGEKVSFSLNIEMKQGMSGSIRNEITYKSLENLGII

SEQ ID NO: 467 - protein, 274 aa, Unknown
  resistance gene
MNIKALLLITSAIFISACSPYIVTANPNHSASKSDEKAEKIKNLFNEAHTTGVLVIQQGQTQQSYGNDLARASTEYVPASTFKMLNALIGLEHHKATTTEVFKWDGQKRLFPEWEKDMTLGDAMKASAIAVYQDLARRIGLELMSKEVKRVGYGNADIGTQVDNFWLVGPLKITPQQEAQFAYKLANKTLPFSPKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 468 - protein, 274 aa, Unknown
  resistance gene
MNIKALLLITSAIFISACSPYIVTANPNHSASKSDEKAEKIKNLFNEAHTTGVLVIQQGQTQQSYGNDLARASTEYVPASTFKMLNALIGLEHHKATTTEVFKWDGQKRLFPEWEKDMTLGDAIKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 469 - protein, 273 aa, Unknown
  resistance gene
MKILIFLPLLSCLGLTACSLPVSSLPSQSISTQAIASLFDQAQSSGVLVIQRDQQVQVYGNDLNRANTEYVPASTFKMLNALIGLQHGKATTNEIFKWDGKKRSFTAWEKDMTLGQAMQASAVPVYQELARRIGLELMQQEVQRIQFGNQQIGQQVDNFWLVGPLKVTPKQEVQFVSALAREQLAFDPQVQQQVKAMLFLQERKAYRLYVKSGWGMDVEPQVGWLTGWVETPQAEIVAFSLNMQMQNGIDPAIRLEILQQALAELGLYPKAEG

SEQ ID NO: 470 - protein, 262 aa, Unknown
  resistance gene
MHKHMSKLFIAFLAFLLSVPAAAEDQTLAELFAQQGIDGTIVISSLHNGKTFIHNDPRAKQRFSTASTFKILNTLISLEEKAISGKDDVLKWDGHIYDFPDWNRDQTLESAFKVSCVWCYQALARQVGAEKYRNYLRKSVYGELREPFEETTFWLDGSLQISAIEQVNFLKKVHLRTLPFSASSYETLRQIMLIEQTPAFTLRAKTGWATRVKPQVGWYVGHVETPTDVWFFATNIEVRDEKDLPLRQKLTRKALQAKGIIE

SEQ ID NO: 471 - protein, 266 aa, Unknown
  resistance gene
MKTFAAYVITACLSSTALASSITENTSWNKEFSAEAVNGVFVLCKSSSKSCATNNLARASKEYLPASTFKIPNAIIGLETGVIKNEHQVFKWDGKPRAMKQWERDLSLRGAIQVSAVPVFQQIAREVGEVRMQKYLKKFSYGNQNISGGTDKFWLEDQLRISAVNQVEFLESLFLNKLSASKENQLIVKEALVTEAAPEYLVHSKTGFSGVGTESNPGVAWWVGWVEKGTEVYFFAFNMDIDNENKLPLRKSIPTKIMASEGIIGG

SEQ ID NO: 472 - protein, 274 aa, Unknown
  resistance gene
MNIKALLLITSAIFISACSPYIVTANPNHSASKSDEKAEKIKNLFNEAHTTGVLVIQQGQTQQSYGNDLARASTEYVPASTFKMLNALIGLEHHKATTTEVFKWDGKKRLFPEWEKDMTLGDAMKASAILVYQDLARRIGLELMSKEVKRVGYGNADIGTQVDNFWLVGPLKITPQQEAQFAYKLANKTLPFSQKVQDEVQSMLFIEEKNGNKIYAKSGWGLDVDPQVGWLTGWVVQPQGNIVAFSLNLEMKKGIPSSVRKEITYKSLEQLGIL

SEQ ID NO: 473 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIQVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 474 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAMPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 475 - protein, 274 aa, Unknown
  resistance gene
MNIKALLLITSAIFISACSPYIVTANPNHSASKSDEKAEKIKNLFNEVHTTGVLVIQQGQTQQSYGNDLARASTEYVPASTFKMLNALIGLEHHKATTTEVFKWDGKKRLFPEWEKNMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 476 - protein, 261 aa, Unknown
  resistance gene
MRVLALSAVFLVASIIGMPAVAKEWQENKSWNAHFTEHKSQGVVVLWNENKQQGFTNNLKRANQAFLPASTFKIPNSLIALDLGVVKDEHQVFKWDGQTRDIATWNRDHNLITAMKYSVVPVYQEFARQIGEARMSKMLHAFDYGNEDISGNVDSFWLDGGIRISATEQISFLRKLYHNKLHVSERSQRIVKQAMLTEANGDYIIRAKTGYDTKIGWWVGWVELDDNVWFFAMNMDMPTSDGLGLRQAITKEVLKQEKIIP

SEQ ID NO: 477 - protein, 269 aa, Unknown
  resistance gene
MSKKNFILIFIFVILISCKNTEKTSNETTLIDNIFTNSNAEGTLVIYNLNDDKYIIHNKERAEQRFYPASTFKIYNSLIGLNEKAVKDVDEVFYKYNGEKVFLESWAKDSNLRYAIKNSQVPAYKELARRIGLEKMKENIEKLDFGNKNIGDSVDTFWLEGPLEISAMEQVKLLTKLAQNELPYPIEIQKAVSDITILEQTDNYTLHGKTGLADSENMTTEPIGWLVGWLEENNNIYVFALNIDNINSDDLAKRINIVKESLKALNLLK

SEQ ID NO: 478 - protein, 274 aa, Unknown
  resistance gene
MNIKALFLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 479 - protein, 274 aa, Unknown
  resistance gene
MNIKALFLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPSSQKVQDEVQSMLFIEEKNGNKMYAKSGWGWDVNPQVGWLTGWVVQPQGNIVAFSLNLEMKKGIPSSVRKEITYKSLEQLGIL

SEQ ID NO: 480 - protein, 274 aa, Unknown
  resistance gene
MNIKALFLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWVVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEIAYKSLEQLGIL

SEQ ID NO: 481 - protein, 275 aa, Unknown
  resistance gene
MAIRIFAILFSIFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGNADPSTSNGDCWIEGSLAISAQEQIAFLRKLYRNELPFRVEHQRLVKDLMIVEAGRNWILRAKTGWEGRMGWWVGWVEWPTGSVFFALNIDTPNRMDDLFKREAIVRAILRSIEALPPNPAVNSDAAR

SEQ ID NO: 482 - protein, 274 aa, Unknown
  resistance gene
MNIKTLLLITSAIFISACSPYIVTANPNHSASKSDEKAEKIKNLFNEVHTTGVLVIQQGQTQQSYGNDLARASTEYVPASTFKMLNALIGLEHHKATTTEVFKWDGQKRLFPEWEKDMTLGDAMKASAIPVYQDLARRIGLELMSKEVKRVGYGNADIGTQVDNFWVVGPLKITPQQEAQFAYKLANKTLPFSPKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 483 - protein, 274 aa, Unknown
  resistance gene
MNIKTLLLITSAIFISACSPYIVTANPNHSASKSDEKAEKIKNLFNEVHTTGVLVIQQGQTQQSYGNDLARASTEYVPASTFKMLNALIGLEYHKATTTEVFKWDGQKRLFPEWEKDMTLGDAMKASAIPVYQDLARRIGLELMSKEVKRVGYGNADIGTQVDNFWLVGPLKITPQQEAQFAYKLANKTLPFSPKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 484 - protein, 266 aa, Unknown
  resistance gene
MAIRFLTILLSTFFLTSFVHAQEHVVVRSDWKKFFSDLQAEGAIVIADERQAEHALLVFGQERAAKRYSPASTFKLPHTLFALDAGAVRDEFQVFRWDGVKRSFAGHNQDQDLRSAMRNSAVWVYELFAKEIGEDNARRYLKQIDYGNADPSTIKGNYWIDGNLEISAHEQISFLRKLYRNQLPFQVEHQRLVKYLMITEAGRNWILRAKTGWEGRFGWWIGWVEWPTGPVFFALNIDTPNRTDDLFKREAIARAILRSIDALPPN

SEQ ID NO: 485 - protein, 265 aa, Unknown
  resistance gene
MRVLALSAVFLVASIIGMPAVAKEWQENKSWNAHFTEHKSQGVVVLWNENKQQGFTNNLKRANQAFLPASTFKIPNSLIALDLGVVKDEHQVFKWDGQTRDIAAWNRDHDLITAMKYSVVPVYQEFARQIGEARMSKMLHAFDYGNEDISGNVDSFWLDGGIRISATQQIAFLRKLYHNKLHVSERSQRIVKQAMLTEANGDYIIRAKTGYSTRIEPKIGWWVGWVELDDNVWFFAMNMDMPTSDGLGLRQAITKEVLKQEKIIP

SEQ ID NO: 486 - protein, 273 aa, Unknown
  resistance gene
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKSQVGWLTGWVEQPDGKIVAFALNMEMRSEMPASIRNELLMKSLKQLNII

SEQ ID NO: 487 - protein, 274 aa, Unknown
  resistance gene
MNIKALLLITSAIFISACSPYIVTANPNHSASKSDVKAEKIKNLFNEAHTTGVLVIQQGQTQQSYGNDLARASTEYVPASTFKMLNALIGLEHHKATTTEVFKWDGKKRLFPEWEKDMTLGDAMKASAISVYQDLARRIGLELMSKEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 488 - protein, 275 aa, Unknown
  resistance gene
MAIRIFAILFSIFSLATFAHAQEGTLERSDWRKFFSEFQAKGTIVVADERQADRAMLVFDPVRSKKRYSPASTFKIPHTLFALDAGAVRDEFQIFRWDGVNRGFAGHNQDQDLRSAMRNSTVWVYELFAKEIGDDKARRYLKKIDYGNADPSTSNGDYWIEGSLAISAQEQIAFLRKLYRNELPFRVEHQRLVKDLMIVEAGRNWILRAKTGWEGRMGWWVGWVEWPTGSVFFALNIDTPNRMDDLFKREAIVRAILRSIEALPPNPAVNSDAAR

SEQ ID NO: 489 - protein, 267 aa, Unknown
  resistance gene
MKTIAAYLVLVFYASTALSESISENLAWNKEFSSESVHGVFVLCKSSSNSCTTNNAARASTAYIPASTFKIPNALIGLETGAIKDERQVFKWDGKPRAMKQWEKDLKLRGAIQVSAVPVFQQIAREVGEIRMQKYLNLFSYGNANIGGGIDKFWLEGQLRISAFNQVKFLESLYLNNLPASKANQLIVKEAIVTEATPEYIVHSKTGYSGVGTESSPGVAWWVGWVEKGTEVYFFAFNMDIDNESKLPSRKSISTKIMASEGIIIGG

SEQ ID NO: 490 - protein, 266 aa, Unknown
  resistance gene
MKTFAAYVITACLSSTALASSITENTFWNKEFSAEAVNGVFVLCKSSSKLACATNNLARASKEYLPASTFKIPNAIIGLETGVIKNEHQIFKWDGKPRAMKQWERDLSLRGAIQVSAVPVFQQIAREVGEVRMQKYLKKFSYGNQNISGGIDKFWLEGQLRISAVNQVEFLESLFLNKLSASKENQLIVKEALVTEAPEYLVHSKTGFSGVGTESNPGVAWWVGWVEKGAEVYFFAFNMDIDNENKLPLRKSIPTKIMASEGIIGG

SEQ ID NO: 491 - protein, 275 aa, Unknown
  resistance gene
MAIRIFAILFSTFVFGTFAHAQEGMRERSDWRKFFSEFQAKGTIVVADERQTDRVILVFDQVRSEKRYSPASTFKIPHTLFALDAGAARDEFQVFRWDGIKRSFAAHNQDQDLRSAMRNSTVWIYELFAKEIGEDKARRYLKQIDYGNADPSTSNGDYWIDGNLAIAAQEQIAFLRKLYHNELPFRVEHQRLVKDLMIVEAGRNWILRAKTGWEGRMGWWVGWVEWPTGPVFFALNIDTPNRMDDLFKREAIVRAILRSIEALPPNPAVNSDAAR

SEQ ID NO: 492 - protein, 266 aa, Unknown
  resistance gene
MKTFAAYVIIACLSSTALAGSITENTSWNKEFSAEAVNGVFVLCKSSSKSCATNDLARASKEYLPASTFKIPNAIIGLETGVIKNEHQVFKWDGKPRAMKQWERDLTLRGAIQVSAVPVFQQIAREVGEVRMQKYLKKFSYGSQNISGGIDKFWLEDQLRISAVNQVEFLESLYLNKLSASKENQLIVKEALVTEAAPEYLVHSKTGFSGVGTESNPGVAWWVGWVEKETEVYFFAFNMDIDNESKLPLRKSIPTKIMESEGIIGG

SEQ ID NO: 493 - protein, 273 aa, Unknown
  resistance gene
MNKYFTCYVVASLFLSGCTVQHNLINETPSQIVQGHNQVIHQYFDEKNTSGVLVIQTDKKINLYGNALSRANTEYVPASTFKMLNALIGLENQKTDINEIFKWKGEKRSFTAWEKDMTLGEAMKLSAVPVYQELARRIGLDLMQKEVKRIGFGNAEIGQQVDNFWLVGPLKVTPIQEVEFVSQLAHTQLPFSEKVQANVKNMLLLEESNGYKIFGKTGWAMDIKPQVGWLTGWVEQPDGKIVAFALNMEMRSEMPASIRNELLMKSLKQLNII

SEQ ID NO: 494 - protein, 266 aa, Unknown
  resistance gene
MKKLSVLLWLTLFYCGTIWAQSTCFLVQENQTVLKHEGKDCNKRFAPESTFKIALSLMGFDSGILKDTLNPEWPYKKEYELYLNVWKYPHNPRTWIRDSCVWYSQVLTQQLGMTRFKNYVDAFHYGNQDISGDKGQNNGLTHSWLSSSLAISPSEQIQFLQKIVNKKLSVNPKAFTMTKDILYIQELAGGWKLYGKTGNGRQLTKDKSQKLSLQHGWFIGWIEKDGRVITFTKHIADSKKHVTFASFRAKNETLNQLFYLINELEK

SEQ ID NO: 495 - protein, 274 aa, Unknown
  resistance gene
MNIKTLLLITSAIFISACSPYIVTANPNHSASKSDEKAEKIKNLFNEVHTTGVLVIQQGQTQQSYGNDLARASTEYVPASTFKMLNALIGLEHHKATTTEVFKWDGQKRLFPEWEKDMTLGDAMKASAIPVYQDLARRIGLELMSKEVKRVGYGNADIGTQVDNFWLVGPLKITPQQEAQFAYKLANKTLPFSPKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 496 - protein, 269 aa, Unknown
  resistance gene
MKFRHALSSAFVLLGCIAASAHAKTICTAIADAGTGKLLVQDGDCGRRASPASTFKIAISLMGYDAGFLRNEHDPVLPYRDSYIAWGGEAWKQPTDPTRWLKYSVVWYSQQVAHHLGAQRFAQYAKAFGYGNADVSGDPGQNNGLDRAWIGSSLQISPLEQLEFLGKMLNRKLPVSPTAVDMTERIVESTTLADGTVVHGKTGVSYPLLADGTRDWARGSGWFVGWIVRGNQTLVFARLTQDERKQPVSAGIRTREAFLRDLPRLLAAR

SEQ ID NO: 497 - protein, 269 aa, Unknown
  resistance gene
MKFRHALSSAFVLLGCIAASAHAKTICTAIADAGTGKLLVQDGDCGRRASPASTFKIAISLMGYDAGFLRNEHDPVLPYRDSYIAWGGEAWKQPTDPTRWLKYPVVWYSQQVAHHLGAQRFAQYAKAFGYGNADVSGDPGQNNGLDRAWIGSSLQISPLEQLEFLGKMLNRKLPVSPTAVDMTERIVESTTLADGTVVHGKTGVSYPLLADGTRDWARGSGWFVGWIVRGKQTLVFARLTQDERKQPVSAGIRTREAFLRDLPRLLAAR

SEQ ID NO: 498 - protein, 264 aa, Unknown
  resistance gene
MRGKHTVILGAALSALFAGAAGAQMLECTLVADAASGQELYRKGACDKAFAPMSTFKVPLAVMGYDAGILVDAHNPRWDYKPEFNGYKFQQKTTDPTIWEKDSIVWYSQQLTRKMGQKRFAAYVAGFGYGNGDISGEPGKSNGLTHSWLGSSLKISPEGQVRFVRDLLSAKLPASKDAQQMTVSILPHFAAGDWAVQGKTGTGSFIDARGAKAPLGWFIGWATHEERRVVFARMTAGGKKGEQPAGPAARDAFLKALPDLAKRF

SEQ ID NO: 499 - protein, 269 aa, Unknown
  resistance gene
MKFRHALSSAFVLLGCIAASAHAKTICTAIADAGTGKLLVQDGDCGRRASPASTFKIAISLMGYDAGFLRNEHDPVLPYRDSYIAWGGEAWKQPTDPTRWLKYSVVWYSQQVAHHLGAQRFAQYAKAFGYGNADVSGDPGQNNGLDRAWIGSSLQISPLEQLEFLGKMLDRKLPVSPTAVDMTERIVESTTLADGTVVHGKTGVSYPLLADGTRDWARGSGWFVGWIVRGKQTLVFARLTQDERKQPVSAGIRTREAFLRDLPRLLAAR

SEQ ID NO: 500 - protein, 269 aa, Unknown
  resistance gene
MKFRHALSSAFVLLGCIAASAHAKTICTAIADAGTGKLLVQDGDCGRRASPASTFKIAISLMGYDAGFLRNEHDPVLPYRDSYIAWGGEAWKQPTDPTRWLKYSVVWYSQQVAHHLGAQRFAQYAKAFGYGNADVSGDPGQNNGLDRAWIGSSLQISPLEQLEFLGKMLNRKLPVSPTAVDMTERIVESTTLADGTVVHGKTGVSYPLLADGTRDWARGSGWFVGWIVRGKQTLVFARLTQDERKQPVSAGIRTREAFLRDLPRLLAAR

SEQ ID NO: 501 - protein, 266 aa, Unknown
  resistance gene
MKTFAAYVIIACLSSTALAGSITENTSWNKEFSAEAVNGVFVLCKSSSKSCATNDLARASKEYLPVSTFKIPSAIIGLETGVIKNEHQVFKWDGKPRAMKQWERDLTLRGAIQVSAVPVFQQIAREVGEVRMQKYLKKFSYGNQNISGGIDKFWLEGQLRISAVNQVEFLESLYLNKLSASKENQLIVKEALVTEAAPEYLVHSKTGFSGVGTESNPGVAWWVGWVEKETEVYFFAFNMDIDNESKLPLRKSIPTKIMESEGIIGG

SEQ ID NO: 502 - protein, 274 aa, Unknown
  resistance gene
MNIKALLLITSAIFISACSPYIVTANPNHSASKSDEKAEKIKNLFNEAHTTGVLVIQQGQTQQSYGNDLARASTEYVPASTFKMLNALIGLEHHKATTTEVFKWDGKKRLFPEWEKDMTLGDAMKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 503 - protein, 274 aa, Unknown
  resistance gene
MNIKALLLITSAIFISACSPYIVSANPNHSASKSDEKAEKIKNLFNEAHTTGVLVIQQGQTQQSYGNDLARASTEYVPASTFKMLNALIGLEHHKATTTEVFKWDGQKRLFPEWEKNMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVNPQVGWLTGWVVQPQGNIVAFSLNLEMKKGIPSSVRKEITYKSLEQLGIL

SEQ ID NO: 504 - protein, 266 aa, Unknown
  resistance gene
MKTFAAYVITACLSSTALASSITENTFWNKEFSAEAVNGVFVLCKSSSKSCATNNLARASKEYLPASTFKIPNAIIGLETGVIKNEHQVFKWDGKPRAMKQWERDLSLRGAIQVSAVPVFQQIAREVGEVRMQKYLKKFSYGNQNISGGIDKFWLEGQLRISAVNQVEFLESLFLNKLSASKENQLIVKEALVTEAAPEYLVHSKTGFSGVGTESNPGVAWWVGWVEKGTEVYFFAFNMDIDNENKLPLRKSIPTKIMASEGIIGG

SEQ ID NO: 505 - protein, 267 aa, Unknown
  resistance gene
MKTIAAYLVLVFFAGTALSESISENLAWNKEFSSESVHGVFVLCKSSSNSCTTNNATRASTAYIPASTFKIPNALIGLETGAIKDARQVFKWDGKPRAMKQWEKDLTLRGAIQVSAVPVFQQIARDIGKKRMQKYLNLFSYGNANIGGGIDKFWLEGQLRISAVNQVKFLESLYLNNLPASKANQLIVKEAIVTEATPEYIVHSKTGYSGVGTESNPGVAWWVGWVEKGTEVYFFAFNMDIDNESKLPSRKSIPTKIMASEGIIIGG

SEQ ID NO: 506 - protein, 275 aa, Unknown
  resistance gene
MKKFILPIFSISILVSLSACSSIKTKSEDNFHISSQQHEKAIKSYFDEAQTQGVIIIKEGKNLSTYGNALARANKEYVPASTFKMLIALIGLENHKATTNEIFKWDGKKRTYPMWEKDMTLGEAMALSAVPVYQELARRTGLELMQKEVKRVNFGNTNIGTQVDNFWLVGPLKITPVQEVNFADDLAHNRLPFKLETQEEVKKMLLIKEVNGSKIYAKSGWGMGVTPQVGWLTGWVEQANGKKIPFSLNLEMKEGMSGSIRNEITYKSLENLGII

SEQ ID NO: 507 - protein, 274 aa, Unknown
  resistance gene
MNIKALLLITSAIFISACSPYIVTANPNHSASKSDDKAEKIKNLFNEAHTTGVLVIHQGQTQQSYGNDLARASTEYVPASTFKMLNALIGLEHHKATTTEVFKWNGQKRLFPEWEKDMTLGDAMKASAIPVYQDLARRIGLELMSNEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 508 - protein, 274 aa, Unknown
  resistance gene
MNIKALLLITSAISISACSPYIVTANPNHSASKSDEKAEKIKNLFNEAHTTGVLVIQQGQTQQSYGNDLARASTEYVPASTFKMLNALIGLEHHKATTTEVFKWDGQKRLFPEWEKDMTLGDAIKASAIPVYQDLARRIGLELMSKEVKRVGYGNADIGTQVDNFWLVGPLKITPQQEAQFAYKLANKTLPFSQKVQDEVQSMLFIEEKNGNKIYAKSGWGWDVDPQVGWLTGWVVQPQGNIVAFSLNLEMKKGIPSSVRKEITYKSLEQLGIL

SEQ ID NO: 509 - protein, 20 aa, Unknown
  resistance gene
AAAYELAENLFEAGQADGWR

SEQ ID NO: 510 - protein, 12 aa, Unknown
  resistance gene
AAEGFIPASTFK

SEQ ID NO: 511 - protein, 5 aa, Unknown
  resistance gene
AALGR

SEQ ID NO: 512 - protein, 15 aa, Unknown
  resistance gene
ADGQVVAFALNMQMK

SEQ ID NO: 513 - protein, 8 aa, Unknown
  resistance gene
ADINEIFK

SEQ ID NO: 514 - protein, 5 aa, Unknown
  resistance gene
ADWGK

SEQ ID NO: 515 - protein, 11 aa, Unknown
  resistance gene
AEGAIVISDER

SEQ ID NO: 516 - protein, 10 aa, Unknown
  resistance gene
AFALNLDIDK

SEQ ID NO: 517 - protein, 9 aa, Unknown
  resistance gene
AFAPMSTFK

SEQ ID NO: 518 - protein, 21 aa, Unknown
  resistance gene
AFGYGNADVSGDPGQNNGLDR

SEQ ID NO: 519 - protein, 6 aa, Unknown
  resistance gene
AFTMTK

SEQ ID NO: 520 - protein, 8 aa, Unknown
  resistance gene
AGDDIALR

SEQ ID NO: 521 - protein, 15 aa, Unknown
  resistance gene
AGHVYAFALNIDMPR

SEQ ID NO: 522 - protein, 5 aa, Unknown
  resistance gene
AGLWR

SEQ ID NO: 523 - protein, 12 aa, Unknown
  resistance gene
AHTEYVPASTFK

SEQ ID NO: 524 - protein, 8 aa, Unknown
  resistance gene
AIIPWDGK

SEQ ID NO: 525 - protein, 10 aa, Unknown
  resistance gene
AIIPWDGKPR

SEQ ID NO: 526 - protein, 9 aa, Unknown
  resistance gene
AISDITITR

SEQ ID NO: 527 - protein, 5 aa, Unknown
  resistance gene
AISGK

SEQ ID NO: 528 - protein, 6 aa, Unknown
  resistance gene
ALGQDR

SEQ ID NO: 529 - protein, 7 aa, Unknown
  resistance gene
ALPDLAK

SEQ ID NO: 530 - protein, 5 aa, Unknown
  resistance gene
ALQAK

SEQ ID NO: 531 - protein, 12 aa, Unknown
  resistance gene
AMETFSPASTFK

SEQ ID NO: 532 - protein, 8 aa, Unknown
  resistance gene
AMLFLQER

SEQ ID NO: 533 - protein, 9 aa, Unknown
  resistance gene
AMLVFDPVR

SEQ ID NO: 534 - protein, 16 aa, Unknown
  resistance gene
AMTLLESGPGWELHGK

SEQ ID NO: 535 - protein, 10 aa, Unknown
  resistance gene
ANLHITLHGK

SEQ ID NO: 536 - protein, 7 aa, Unknown
  resistance gene
ANQLIVK

SEQ ID NO: 537 - protein, 12 aa, Unknown
  resistance gene
ANTEYVPASTFK

SEQ ID NO: 538 - protein, 5 aa, Unknown
  resistance gene
ANVSR

SEQ ID NO: 539 - protein, 12 aa, Unknown
  resistance gene
APIGWFIGWATR

SEQ ID NO: 540 - protein, 15 aa, Unknown
  resistance gene
APLGWFIGWATHEER

SEQ ID NO: 541 - protein, 14 aa, Unknown
  resistance gene
AQDEVQSMLFIEEK

SEQ ID NO: 542 - protein, 12 aa, Unknown
  resistance gene
AQGVIVLWNENK

SEQ ID NO: 543 - protein, 12 aa, Unknown
  resistance gene
ASAIAVYQDLAR

SEQ ID NO: 544 - protein, 12 aa, Unknown
  resistance gene
ASAILVYQDLAR

SEQ ID NO: 545 - protein, 12 aa, Unknown
  resistance gene
ASAIPVYQDLAR

SEQ ID NO: 546 - protein, 12 aa, Unknown
  resistance gene
ASAIPVYQDLPR

SEQ ID NO: 547 - protein, 12 aa, Unknown
  resistance gene
ASAIQVYQDLAR

SEQ ID NO: 548 - protein, 12 aa, Unknown
  resistance gene
ASAISVYQDLAR

SEQ ID NO: 549 - protein, 12 aa, Unknown
  resistance gene
ASALPVYQDLAR

SEQ ID NO: 550 - protein, 12 aa, Unknown
  resistance gene
ASAMPVYQDLAR

SEQ ID NO: 551 - protein, 12 aa, Unknown
  resistance gene
ASAVPVYQDLAR

SEQ ID NO: 552 - protein, 12 aa, Unknown
  resistance gene
ASIEYVPASTFK

SEQ ID NO: 553 - protein, 12 aa, Unknown
  resistance gene
ASNVPVYQELAR

SEQ ID NO: 554 - protein, 8 aa, Unknown
  resistance gene
ASPASTFK

SEQ ID NO: 555 - protein, 12 aa, Unknown
  resistance gene
ASTAYIPASTFK

SEQ ID NO: 556 - protein, 12 aa, Unknown
  resistance gene
ASTEYVPASTFK

SEQ ID NO: 557 - protein, 8 aa, Unknown
  resistance gene
ASTTEVFK

SEQ ID NO: 558 - protein, 8 aa, Unknown
  resistance gene
ATSTEIFK

SEQ ID NO: 559 - protein, 8 aa, Unknown
  resistance gene
ATTNEIFK

SEQ ID NO: 560 - protein, 8 aa, Unknown
  resistance gene
ATTTAVFK

SEQ ID NO: 561 - protein, 8 aa, Unknown
  resistance gene
ATTTEIFK

SEQ ID NO: 562 - protein, 8 aa, Unknown
  resistance gene
ATTTEVFK

SEQ ID NO: 563 - protein, 19 aa, Unknown
  resistance gene
AVSDITILEQTDNYTLHGK

SEQ ID NO: 564 - protein, 19 aa, Unknown
  resistance gene
AVSDITILEQTYNYTLHGK

SEQ ID NO: 565 - protein, 16 aa, Unknown
  resistance gene
AVVPHFEAGDWDVQGK

SEQ ID NO: 566 - protein, 9 aa, Unknown
  resistance gene
AWEHDMSLR

SEQ ID NO: 567 - protein, 20 aa, Unknown
  resistance gene
AWIGSSLQISPLEQLEFLGK

SEQ ID NO: 568 - protein, 12 aa, Unknown
  resistance gene
CAAQMAPDSTFK

SEQ ID NO: 569 - protein, 12 aa, Unknown
  resistance gene
CATQMAPDSTFK

SEQ ID NO: 570 - protein, 21 aa, Unknown
  resistance gene
CTIIADAITGNTLYETGECAR

SEQ ID NO: 571 - protein, 5 aa, Unknown
  resistance gene
DAFLK

SEQ ID NO: 572 - protein, 8 aa, Unknown
  resistance gene
DDFILHGK

SEQ ID NO: 573 - protein, 11 aa, Unknown
  resistance gene
DDQEVLPYGGK

SEQ ID NO: 574 - protein, 5 aa, Unknown
  resistance gene
DDVLK

SEQ ID NO: 575 - protein, 7 aa, Unknown
  resistance gene
DEFHVFR

SEQ ID NO: 576 - protein, 7 aa, Unknown
  resistance gene
DEFQIFR

SEQ ID NO: 577 - protein, 7 aa, Unknown
  resistance gene
DEFQVFR

SEQ ID NO: 578 - protein, 5 aa, Unknown
  resistance gene
DELVR

SEQ ID NO: 579 - protein, 5 aa, Unknown
  resistance gene
DETSR

SEQ ID NO: 580 - protein, 13 aa, Unknown
  resistance gene
DFDYGNQDFSGDK

SEQ ID NO: 581 - protein, 21 aa, Unknown
  resistance gene
DFTLGEAMQASTVPVYQELAR

SEQ ID NO: 582 - protein, 21 aa, Unknown
  resistance gene
DGNITSVAINIDMLSEADAPK

SEQ ID NO: 583 - protein, 9 aa, Unknown
  resistance gene
DHDLITAMK

SEQ ID NO: 584 - protein, 7 aa, Unknown
  resistance gene
DIAAWNR

SEQ ID NO: 585 - protein, 6 aa, Unknown
  resistance gene
DIGEDK

SEQ ID NO: 586 - protein, 13 aa, Unknown
  resistance gene
DILYIQELAGGWK

SEQ ID NO: 587 - protein, 7 aa, Unknown
  resistance gene
DITILEK

SEQ ID NO: 588 - protein, 6 aa, Unknown
  resistance gene
DLLSAK

SEQ ID NO: 589 - protein, 9 aa, Unknown
  resistance gene
DLMITEAGR

SEQ ID NO: 590 - protein, 9 aa, Unknown
  resistance gene
DLMIVEAGR

SEQ ID NO: 591 - protein, 8 aa, Unknown
  resistance gene
DLMIVEAK

SEQ ID NO: 592 - protein, 5 aa, Unknown
  resistance gene
DLPLR

SEQ ID NO: 593 - protein, 8 aa, Unknown
  resistance gene
DLSGNPGK

SEQ ID NO: 594 - protein, 5 aa, Unknown
  resistance gene
DLSLR

SEQ ID NO: 595 - protein, 5 aa, Unknown
  resistance gene
DLTLR

SEQ ID NO: 596 - protein, 9 aa, Unknown
  resistance gene
DMTLGDAIK

SEQ ID NO: 597 - protein, 21 aa, Unknown
  resistance gene
DMTLGDAMALSAVPVYQELAR

SEQ ID NO: 598 - protein, 9 aa, Unknown
  resistance gene
DMTLGDAMK

SEQ ID NO: 599 - protein, 21 aa, Unknown
  resistance gene
DMTLGEAMALSAVPVYQDLAR

SEQ ID NO: 600 - protein, 21 aa, Unknown
  resistance gene
DMTLGEAMALSAVPVYQELAR

SEQ ID NO: 601 - protein, 9 aa, Unknown
  resistance gene
DMTLGEAMK

SEQ ID NO: 602 - protein, 21 aa, Unknown
  resistance gene
DMTLGQAMQASAVPVYQELAR

SEQ ID NO: 603 - protein, 5 aa, Unknown
  resistance gene
DNNGK

SEQ ID NO: 604 - protein, 5 aa, Unknown
  resistance gene
DQDLR

SEQ ID NO: 605 - protein, 13 aa, Unknown
  resistance gene
DQQIGWFVGWASK

SEQ ID NO: 606 - protein, 16 aa, Unknown
  resistance gene
DQQIGWFVGWASKPGK

SEQ ID NO: 607 - protein, 13 aa, Unknown
  resistance gene
DQQVQVYGNDLNR

SEQ ID NO: 608 - protein, 5 aa, Unknown
  resistance gene
DQSFR

SEQ ID NO: 609 - protein, 9 aa, Unknown
  resistance gene
DQTLESAFK

SEQ ID NO: 610 - protein, 18 aa, Unknown
  resistance gene
DSCVWYSQVLTQQLGMTR

SEQ ID NO: 611 - protein, 12 aa, Unknown
  resistance gene
DSIVWYSQELTR

SEQ ID NO: 612 - protein, 12 aa, Unknown
  resistance gene
DSIVWYSQQLTR

SEQ ID NO: 613 - protein, 5 aa, Unknown
  resistance gene
DSNLR

SEQ ID NO: 614 - protein, 12 aa, Unknown
  resistance gene
DSYIAWGGEAWK

SEQ ID NO: 615 - protein, 10 aa, Unknown
  resistance gene
DTLNPEWPYK

SEQ ID NO: 616 - protein, 8 aa, Unknown
  resistance gene
DVDEVFYK

SEQ ID NO: 617 - protein, 8 aa, Unknown
  resistance gene
DVSGDPGK

SEQ ID NO: 618 - protein, 5 aa, Unknown
  resistance gene
DWILR

SEQ ID NO: 619 - protein, 10 aa, Unknown
  resistance gene
DWPAMAGAWR

SEQ ID NO: 620 - protein, 5 aa, Unknown
  resistance gene
EAFLR

SEQ ID NO: 621 - protein, 5 aa, Unknown
  resistance gene
EAIAR

SEQ ID NO: 622 - protein, 5 aa, Unknown
  resistance gene
EAIVR

SEQ ID NO: 623 - protein, 16 aa, Unknown
  resistance gene
EAIVTEATPEYIVHSK

SEQ ID NO: 624 - protein, 16 aa, Unknown
  resistance gene
EALVTEAAPEYLVHSK

SEQ ID NO: 625 - protein, 15 aa, Unknown
  resistance gene
EALVTEAPEYLVHSK

SEQ ID NO: 626 - protein, 5 aa, Unknown
  resistance gene
EEIVR

SEQ ID NO: 627 - protein, 12 aa, Unknown
  resistance gene
EEVLAALPAQLK

SEQ ID NO: 628 - protein, 6 aa, Unknown
  resistance gene
EFNGSK

SEQ ID NO: 629 - protein, 15 aa, Unknown
  resistance gene
EFSAEAVNGVFVLCK

SEQ ID NO: 630 - protein, 15 aa, Unknown
  resistance gene
EFSSESVHGVFVLCK

SEQ ID NO: 631 - protein, 6 aa, Unknown
  resistance gene
EGDMAK

SEQ ID NO: 632 - protein, 8 aa, Unknown
  resistance gene
EGMSGSIR

SEQ ID NO: 633 - protein, 8 aa, Unknown
  resistance gene
EGMTGSIR

SEQ ID NO: 634 - protein, 6 aa, Unknown
  resistance gene
EGSCDK

SEQ ID NO: 635 - protein, 7 aa, Unknown
  resistance gene
EIAVWNR

SEQ ID NO: 636 - protein, 5 aa, Unknown
  resistance gene
EIAYK

SEQ ID NO: 637 - protein, 5 aa, Unknown
  resistance gene
EIFER

SEQ ID NO: 638 - protein, 7 aa, Unknown
  resistance gene
EIFYHYR

SEQ ID NO: 639 - protein, 6 aa, Unknown
  resistance gene
EIGDDK

SEQ ID NO: 640 - protein, 6 aa, Unknown
  resistance gene
EIGDGK

SEQ ID NO: 641 - protein, 6 aa, Unknown
  resistance gene
EIGEDK

SEQ ID NO: 642 - protein, 8 aa, Unknown
  resistance gene
EIGEDNAR

SEQ ID NO: 643 - protein, 6 aa, Unknown
  resistance gene
EIGENK

SEQ ID NO: 644 - protein, 5 aa, Unknown
  resistance gene
EIGPK

SEQ ID NO: 645 - protein, 8 aa, Unknown
  resistance gene
EIGSEIDK

SEQ ID NO: 646 - protein, 5 aa, Unknown
  resistance gene
EITYK

SEQ ID NO: 647 - protein, 5 aa, Unknown
  resistance gene
EITYR

SEQ ID NO: 648 - protein, 6 aa, Unknown
  resistance gene
EMIYLK

SEQ ID NO: 649 - protein, 7 aa, Unknown
  resistance gene
EMLYVER

SEQ ID NO: 650 - protein, 5 aa, Unknown
  resistance gene
EMTYK

SEQ ID NO: 651 - protein, 5 aa, Unknown
  resistance gene
ENIEK

SEQ ID NO: 652 - protein, 7 aa, Unknown
  resistance gene
ENQLIVK

SEQ ID NO: 653 - protein, 8 aa, Unknown
  resistance gene
EQAILLFR

SEQ ID NO: 654 - protein, 8 aa, Unknown
  resistance gene
EQIQFLLR

SEQ ID NO: 655 - protein, 14 aa, Unknown
  resistance gene
EQLAFDPQVQQQVK

SEQ ID NO: 656 - protein, 8 aa, Unknown
  resistance gene
EQVDFVQR

SEQ ID NO: 657 - protein, 18 aa, Unknown
  resistance gene
ETEVYFFAFNMDIDNESK

SEQ ID NO: 658 - protein, 6 aa, Unknown
  resistance gene
ETTTPR

SEQ ID NO: 659 - protein, 6 aa, Unknown
  resistance gene
EVGEIR

SEQ ID NO: 660 - protein, 6 aa, Unknown
  resistance gene
EVGEVR

SEQ ID NO: 661 - protein, 6 aa, Unknown
  resistance gene
EVNGSK

SEQ ID NO: 662 - protein, 6 aa, Unknown
  resistance gene
EWQENK

SEQ ID NO: 663 - protein, 10 aa, Unknown
  resistance gene
EYELYLNVWK

SEQ ID NO: 664 - protein, 9 aa, Unknown
  resistance gene
EYLPASTFK

SEQ ID NO: 665 - protein, 9 aa, Unknown
  resistance gene
EYLPVSTFK

SEQ ID NO: 666 - protein, 14 aa, Unknown
  resistance gene
EYNTSGTFVFYDGK

SEQ ID NO: 667 - protein, 9 aa, Unknown
  resistance gene
EYVPASTFK

SEQ ID NO: 668 - protein, 21 aa, Unknown
  resistance gene
FAAYVAGFGYGNGDISGEPGK

SEQ ID NO: 669 - protein, 8 aa, Unknown
  resistance gene
FAPESTFK

SEQ ID NO: 670 - protein, 6 aa, Unknown
  resistance gene
FAQYAK

SEQ ID NO: 671 - protein, 6 aa, Unknown
  resistance gene
FDYGNK

SEQ ID NO: 672 - protein, 6 aa, Unknown
  resistance gene
FDYGNR

SEQ ID NO: 673 - protein, 6 aa, Unknown
  resistance gene
FEDLYK

SEQ ID NO: 674 - protein, 11 aa, Unknown
  resistance gene
FEDTFHISNQK

SEQ ID NO: 675 - protein, 14 aa, Unknown
  resistance gene
FEDTFHTSNQQHEK

SEQ ID NO: 676 - protein, 14 aa, Unknown
  resistance gene
FEYGNQDVSGDSGK

SEQ ID NO: 677 - protein, 8 aa, Unknown
  resistance gene
FFSDFQAK

SEQ ID NO: 678 - protein, 17 aa, Unknown
  resistance gene
FFSDLQAEGAIVIADER

SEQ ID NO: 679 - protein, 6 aa, Unknown
  resistance gene
FFSDLR

SEQ ID NO: 680 - protein, 8 aa, Unknown
  resistance gene
FFSEFQAK

SEQ ID NO: 681 - protein, 8 aa, Unknown
  resistance gene
FGLEGQLR

SEQ ID NO: 682 - protein, 21 aa, Unknown
  resistance gene
FILPIFSISILVSLSACSSIK

SEQ ID NO: 683 - protein, 20 aa, Unknown
  resistance gene
FLALLFSAVVLVSLGHAQDK

SEQ ID NO: 684 - protein, 20 aa, Unknown
  resistance gene
FLALLFSAVVLVSLGHAQEK

SEQ ID NO: 685 - protein, 14 aa, Unknown
  resistance gene
FLESLYLNNLPASK

SEQ ID NO: 686 - protein, 8 aa, Unknown
  resistance gene
FLLEGQLR

SEQ ID NO: 687 - protein, 7 aa, Unknown
  resistance gene
FQQYVDR

SEQ ID NO: 688 - protein, 7 aa, Unknown
  resistance gene
FSDYVQR

SEQ ID NO: 689 - protein, 8 aa, Unknown
  resistance gene
FSTASTFK

SEQ ID NO: 690 - protein, 6 aa, Unknown
  resistance gene
FSWDGK

SEQ ID NO: 691 - protein, 14 aa, Unknown
  resistance gene
FSYGNQNISGGIDK

SEQ ID NO: 692 - protein, 14 aa, Unknown
  resistance gene
FSYGNQNISGGTDK

SEQ ID NO: 693 - protein, 14 aa, Unknown
  resistance gene
FSYGSQNISGGIDK

SEQ ID NO: 694 - protein, 6 aa, Unknown
  resistance gene
FTEYVK

SEQ ID NO: 695 - protein, 5 aa, Unknown
  resistance gene
FVAHK

SEQ ID NO: 696 - protein, 8 aa, Unknown
  resistance gene
FVPASTYK

SEQ ID NO: 697 - protein, 13 aa, Unknown
  resistance gene
FVYDLAQGQLPFK

SEQ ID NO: 698 - protein, 21 aa, Unknown
  resistance gene
FVYDLAQGQLPFKPEVQQQVK

SEQ ID NO: 699 - protein, 8 aa, Unknown
  resistance gene
FWLEDQLR

SEQ ID NO: 700 - protein, 8 aa, Unknown
  resistance gene
FWLEGPLK

SEQ ID NO: 701 - protein, 8 aa, Unknown
  resistance gene
FWLEGQLR

SEQ ID NO: 702 - protein, 8 aa, Unknown
  resistance gene
FYPASSFK

SEQ ID NO: 703 - protein, 8 aa, Unknown
  resistance gene
FYPASTFK

SEQ ID NO: 704 - protein, 5 aa, Unknown
  resistance gene
GACDK

SEQ ID NO: 705 - protein, 18 aa, Unknown
  resistance gene
GAEVYFFAFNMDIDNENK

SEQ ID NO: 706 - protein, 16 aa, Unknown
  resistance gene
GAIQVSAVPVFQQIAR

SEQ ID NO: 707 - protein, 16 aa, Unknown
  resistance gene
GAIQVSAVPVFQQITR

SEQ ID NO: 708 - protein, 21 aa, Unknown
  resistance gene
GDYWIDGNLEISAHEQISFLR

SEQ ID NO: 709 - protein, 10 aa, Unknown
  resistance gene
GDYWIDGNLK

SEQ ID NO: 710 - protein, 14 aa, Unknown
  resistance gene
GELPVSEDALEMTK

SEQ ID NO: 711 - protein, 10 aa, Unknown
  resistance gene
GEQPAGPAAR

SEQ ID NO: 712 - protein, 12 aa, Unknown
  resistance gene
GFAGHNQDQDLR

SEQ ID NO: 713 - protein, 7 aa, Unknown
  resistance gene
GIPSSVR

SEQ ID NO: 714 - protein, 7 aa, Unknown
  resistance gene
GISSSVR

SEQ ID NO: 715 - protein, 12 aa, Unknown
  resistance gene
GLNGTFVVYDLK

SEQ ID NO: 716 - protein, 12 aa, Unknown
  resistance gene
GMEIWNSNHTPK

SEQ ID NO: 717 - protein, 9 aa, Unknown
  resistance gene
GNQTLVFAR

SEQ ID NO: 718 - protein, 21 aa, Unknown
  resistance gene
GNYWIDGNLEISAHEQISFLR

SEQ ID NO: 719 - protein, 12 aa, Unknown
  resistance gene
GPLEISAFEEAR

SEQ ID NO: 720 - protein, 12 aa, Unknown
  resistance gene
GPLTITPIQEVK

SEQ ID NO: 721 - protein, 11 aa, Unknown
  resistance gene
GSGWFVGWIVR

SEQ ID NO: 722 - protein, 9 aa, Unknown
  resistance gene
GSLLLWDQK

SEQ ID NO: 723 - protein, 18 aa, Unknown
  resistance gene
GTEVYFFAFNMDIDNENK

SEQ ID NO: 724 - protein, 18 aa, Unknown
  resistance gene
GTEVYFFAFNMDIDNESK

SEQ ID NO: 725 - protein, 10 aa, Unknown
  resistance gene
GTFVLYDVQR

SEQ ID NO: 726 - protein, 9 aa, Unknown
  resistance gene
GTIVVADER

SEQ ID NO: 727 - protein, 9 aa, Unknown
  resistance gene
GTIVVLDAR

SEQ ID NO: 728 - protein, 9 aa, Unknown
  resistance gene
GTIVVVDER

SEQ ID NO: 729 - protein, 8 aa, Unknown
  resistance gene
GTLPFSAR

SEQ ID NO: 730 - protein, 7 aa, Unknown
  resistance gene
GTPSSVR

SEQ ID NO: 731 - protein, 20 aa, Unknown
  resistance gene
HALSSAFVLLGCIAASAHAK

SEQ ID NO: 732 - protein, 6 aa, Unknown
  resistance gene
HIADSK

SEQ ID NO: 733 - protein, 14 aa, Unknown
  resistance gene
HNGLTHAWLASSLK

SEQ ID NO: 734 - protein, 18 aa, Unknown
  resistance gene
HNGLTQSWLMSSLTISPK

SEQ ID NO: 735 - protein, 14 aa, Unknown
  resistance gene
HNGTDGAWIISSLR

SEQ ID NO: 736 - protein, 10 aa, Unknown
  resistance gene
HTLSVFDQER

SEQ ID NO: 737 - protein, 8 aa, Unknown
  resistance gene
HVTFASFR

SEQ ID NO: 738 - protein, 14 aa, Unknown
  resistance gene
IAISLMGYDAGFLR

SEQ ID NO: 739 - protein, 16 aa, Unknown
  resistance gene
IALSLMAFDAEIIDQK

SEQ ID NO: 740 - protein, 14 aa, Unknown
  resistance gene
IALSLMGFDSGILK

SEQ ID NO: 741 - protein, 12 aa, Unknown
  resistance gene
IANALIGLENHK

SEQ ID NO: 742 - protein, 11 aa, Unknown
  resistance gene
IAWIVGFVYLK

SEQ ID NO: 743 - protein, 11 aa, Unknown
  resistance gene
IDTFWLDNSLK

SEQ ID NO: 744 - protein, 8 aa, Unknown
  resistance gene
IDYYNLDR

SEQ ID NO: 745 - protein, 14 aa, Unknown
  resistance gene
IFNALIALDSGVIK

SEQ ID NO: 746 - protein, 17 aa, Unknown
  resistance gene
IFNSLLALDSGALDNER

SEQ ID NO: 747 - protein, 14 aa, Unknown
  resistance gene
IFNTLIGLENGIVK

SEQ ID NO: 748 - protein, 8 aa, Unknown
  resistance gene
IGLDLMQK

SEQ ID NO: 749 - protein, 5 aa, Unknown
  resistance gene
IGLEK

SEQ ID NO: 750 - protein, 12 aa, Unknown
  resistance gene
IGLELMQQEVQR

SEQ ID NO: 751 - protein, 8 aa, Unknown
  resistance gene
IGLELMSK

SEQ ID NO: 752 - protein, 11 aa, Unknown
  resistance gene
IGLELMSNEVK

SEQ ID NO: 753 - protein, 5 aa, Unknown
  resistance gene
IGLER

SEQ ID NO: 754 - protein, 5 aa, Unknown
  resistance gene
IGLNK

SEQ ID NO: 755 - protein, 8 aa, Unknown
  resistance gene
IGLNLMQK

SEQ ID NO: 756 - protein, 12 aa, Unknown
  resistance gene
IGPSLMQSELQR

SEQ ID NO: 757 - protein, 18 aa, Unknown
  resistance gene
IGYGNMQIGTEVDQFWLK

SEQ ID NO: 758 - protein, 18 aa, Unknown
  resistance gene
IGYGNMQMGTEVDQFWLK

SEQ ID NO: 759 - protein, 9 aa, Unknown
  resistance gene
IINHNLPVK

SEQ ID NO: 760 - protein, 9 aa, Unknown
  resistance gene
IINHNLPVR

SEQ ID NO: 761 - protein, 14 aa, Unknown
  resistance gene
ILFQQGTQQACAER

SEQ ID NO: 762 - protein, 7 aa, Unknown
  resistance gene
ILNNWFK

SEQ ID NO: 763 - protein, 11 aa, Unknown
  resistance gene
ILNTLISLEEK

SEQ ID NO: 764 - protein, 21 aa, Unknown
  resistance gene
ILSLVCLSISIGACAEHSMSR

SEQ ID NO: 765 - protein, 5 aa, Unknown
  resistance gene
INESR

SEQ ID NO: 766 - protein, 5 aa, Unknown
  resistance gene
INIVK

SEQ ID NO: 767 - protein, 10 aa, Unknown
  resistance gene
INLYGNALSR

SEQ ID NO: 768 - protein, 10 aa, Unknown
  resistance gene
IPFSLNLEMK

SEQ ID NO: 769 - protein, 14 aa, Unknown
  resistance gene
IPHTLFALDADAVR

SEQ ID NO: 770 - protein, 14 aa, Unknown
  resistance gene
IPHTLFALDAGAAR

SEQ ID NO: 771 - protein, 14 aa, Unknown
  resistance gene
IPHTLFALDAGAVR

SEQ ID NO: 772 - protein, 5 aa, Unknown
  resistance gene
IPLGK

SEQ ID NO: 773 - protein, 14 aa, Unknown
  resistance gene
IPNAIIGLETGVIK

SEQ ID NO: 774 - protein, 14 aa, Unknown
  resistance gene
IPNALIGLETGAIK

SEQ ID NO: 775 - protein, 14 aa, Unknown
  resistance gene
IPNSLIAFDTGAVR

SEQ ID NO: 776 - protein, 14 aa, Unknown
  resistance gene
IPSAIIGLETGVIK

SEQ ID NO: 777 - protein, 8 aa, Unknown
  resistance gene
ISAFNQVK

SEQ ID NO: 778 - protein, 11 aa, Unknown
  resistance gene
ISAHEQILFLR

SEQ ID NO: 779 - protein, 8 aa, Unknown
  resistance gene
ISAMEQTR

SEQ ID NO: 780 - protein, 8 aa, Unknown
  resistance gene
ISAMEQVK

SEQ ID NO: 781 - protein, 11 aa, Unknown
  resistance gene
ISATEQVAFLR

SEQ ID NO: 782 - protein, 11 aa, Unknown
  resistance gene
ISATQQIAFLR

SEQ ID NO: 783 - protein, 17 aa, Unknown
  resistance gene
ISAVNQVEFLESLFLNK

SEQ ID NO: 784 - protein, 17 aa, Unknown
  resistance gene
ISAVNQVEFLESLYLNK

SEQ ID NO: 785 - protein, 8 aa, Unknown
  resistance gene
ISAVNQVK

SEQ ID NO: 786 - protein, 11 aa, Unknown
  resistance gene
ISPEEQIQFLR

SEQ ID NO: 787 - protein, 8 aa, Unknown
  resistance gene
ISPEEQVR

SEQ ID NO: 788 - protein, 8 aa, Unknown
  resistance gene
ISPEGQVR

SEQ ID NO: 789 - protein, 11 aa, Unknown
  resistance gene
ISPLEQLAFLR

SEQ ID NO: 790 - protein, 11 aa, Unknown
  resistance gene
ITAFQQVDFLR

SEQ ID NO: 791 - protein, 16 aa, Unknown
  resistance gene
ITLFLLFLNLVFGQDK

SEQ ID NO: 792 - protein, 17 aa, Unknown
  resistance gene
ITPIQEVNFADDFANNR

SEQ ID NO: 793 - protein, 17 aa, Unknown
  resistance gene
ITPIQEVNFADDLANNR

SEQ ID NO: 794 - protein, 12 aa, Unknown
  resistance gene
ITPQQEAQFAYK

SEQ ID NO: 795 - protein, 12 aa, Unknown
  resistance gene
ITPQQEAQFTYK

SEQ ID NO: 796 - protein, 17 aa, Unknown
  resistance gene
ITPVQEVNFADDLAHNR

SEQ ID NO: 797 - protein, 7 aa, Unknown
  resistance gene
IVAFALK

SEQ ID NO: 798 - protein, 11 aa, Unknown
  resistance gene
IVAFALNMEMR

SEQ ID NO: 799 - protein, 16 aa, Unknown
  resistance gene
IVESTTLADGTVVHGK

SEQ ID NO: 800 - protein, 11 aa, Unknown
  resistance gene
IYNSLIGLNEK

SEQ ID NO: 801 - protein, 13 aa, Unknown
  resistance gene
KPDIGWWVGWIER

SEQ ID NO: 802 - protein, 10 aa, Unknown
  resistance gene
LACATNNLAR

SEQ ID NO: 803 - protein, 17 aa, Unknown
  resistance gene
LAQGELPFPAPVQSTVR

SEQ ID NO: 804 - protein, 14 aa, Unknown
  resistance gene
LAQNELPYPIEIQK

SEQ ID NO: 805 - protein, 14 aa, Unknown
  resistance gene
LAQNELQYPIEIQK

SEQ ID NO: 806 - protein, 6 aa, Unknown
  resistance gene
LDFGNK

SEQ ID NO: 807 - protein, 7 aa, Unknown
  resistance gene
LDGSLNR

SEQ ID NO: 808 - protein, 5 aa, Unknown
  resistance gene
LEIGK

SEQ ID NO: 809 - protein, 16 aa, Unknown
  resistance gene
LEILQQALAELGLYPK

SEQ ID NO: 810 - protein, 8 aa, Unknown
  resistance gene
LENQEQVK

SEQ ID NO: 811 - protein, 9 aa, Unknown
  resistance gene
LETQEEVEK

SEQ ID NO: 812 - protein, 8 aa, Unknown
  resistance gene
LETQEEVK

SEQ ID NO: 813 - protein, 8 aa, Unknown
  resistance gene
LFAAEGVK

SEQ ID NO: 814 - protein, 8 aa, Unknown
  resistance gene
LFESAGVK

SEQ ID NO: 815 - protein, 8 aa, Unknown
  resistance gene
LFGAAGVK

SEQ ID NO: 816 - protein, 7 aa, Unknown
  resistance gene
LFPEWEK

SEQ ID NO: 817 - protein, 5 aa, Unknown
  resistance gene
LGESR

SEQ ID NO: 818 - protein, 5 aa, Unknown
  resistance gene
LGVDR

SEQ ID NO: 819 - protein, 6 aa, Unknown
  resistance gene
LHVSER

SEQ ID NO: 820 - protein, 7 aa, Unknown
  resistance gene
LHYGNAK

SEQ ID NO: 821 - protein, 9 aa, Unknown
  resistance gene
LLNLLSQSK

SEQ ID NO: 822 - protein, 6 aa, Unknown
  resistance gene
LLQDER

SEQ ID NO: 823 - protein, 10 aa, Unknown
  resistance gene
LLVQDGDCGR

SEQ ID NO: 824 - protein, 9 aa, Unknown
  resistance gene
LNEVGYGNR

SEQ ID NO: 825 - protein, 11 aa, Unknown
  resistance gene
LNYGNADPSTK

SEQ ID NO: 826 - protein, 6 aa, Unknown
  resistance gene
LNYGNK

SEQ ID NO: 827 - protein, 5 aa, Unknown
  resistance gene
LPASK

SEQ ID NO: 828 - protein, 14 aa, Unknown
  resistance gene
LPHTLFALDADAVR

SEQ ID NO: 829 - protein, 14 aa, Unknown
  resistance gene
LPHTLFALDAGAVR

SEQ ID NO: 830 - protein, 17 aa, Unknown
  resistance gene
LPLAIMGFDSGILQSPK

SEQ ID NO: 831 - protein, 20 aa, Unknown
  resistance gene
LPLAIMGYDADILLDATTPR

SEQ ID NO: 832 - protein, 14 aa, Unknown
  resistance gene
LPSSLIALETGAVR

SEQ ID NO: 833 - protein, 16 aa, Unknown
  resistance gene
LPVSAQTLQYTANILK

SEQ ID NO: 834 - protein, 6 aa, Unknown
  resistance gene
LPVSER

SEQ ID NO: 835 - protein, 13 aa, Unknown
  resistance gene
LPVSPTAVDMTER

SEQ ID NO: 836 - protein, 5 aa, Unknown
  resistance gene
LSASK

SEQ ID NO: 837 - protein, 12 aa, Unknown
  resistance gene
LSAVPIYQEVAR

SEQ ID NO: 838 - protein, 12 aa, Unknown
  resistance gene
LSAVPVYQELAR

SEQ ID NO: 839 - protein, 17 aa, Unknown
  resistance gene
LSCTLVIDEASGDLLHR

SEQ ID NO: 840 - protein, 14 aa, Unknown
  resistance gene
LSLQHGWFIGWIEK

SEQ ID NO: 841 - protein, 17 aa, Unknown
  resistance gene
LSQNSLPFSQEAMNSVK

SEQ ID NO: 842 - protein, 6 aa, Unknown
  resistance gene
LSVNPK

SEQ ID NO: 843 - protein, 6 aa, Unknown
  resistance gene
LTQDER

SEQ ID NO: 844 - protein, 6 aa, Unknown
  resistance gene
LTVGAR

SEQ ID NO: 845 - protein, 19 aa, Unknown
  resistance gene
LYGFALNIDMPGGEADIGK

SEQ ID NO: 846 - protein, 9 aa, Unknown
  resistance gene
LYHNELPFR

SEQ ID NO: 847 - protein, 5 aa, Unknown
  resistance gene
LYHNK

SEQ ID NO: 848 - protein, 9 aa, Unknown
  resistance gene
LYQNDLPFR

SEQ ID NO: 849 - protein, 6 aa, Unknown
  resistance gene
MDDLFK

SEQ ID NO: 850 - protein, 6 aa, Unknown
  resistance gene
MEDLHK

SEQ ID NO: 851 - protein, 12 aa, Unknown
  resistance gene
MLIALIGLENHK

SEQ ID NO: 852 - protein, 15 aa, Unknown
  resistance gene
MLLIEQQGDAALYAK

SEQ ID NO: 853 - protein, 5 aa, Unknown
  resistance gene
MLLIK

SEQ ID NO: 854 - protein, 12 aa, Unknown
  resistance gene
MLNALIGLEHHK

SEQ ID NO: 855 - protein, 12 aa, Unknown
  resistance gene
MLNALIGLENHK

SEQ ID NO: 856 - protein, 12 aa, Unknown
  resistance gene
MLNALIGLENQK

SEQ ID NO: 857 - protein, 12 aa, Unknown
  resistance gene
MLNALIGLEYHK

SEQ ID NO: 858 - protein, 12 aa, Unknown
  resistance gene
MLNALIGLQHGK

SEQ ID NO: 859 - protein, 12 aa, Unknown
  resistance gene
MLNALISLEHHK

SEQ ID NO: 860 - protein, 13 aa, Unknown
  resistance gene
MQAYVDAFDYGNR

SEQ ID NO: 861 - protein, 7 aa, Unknown
  resistance gene
MQEGLNK

SEQ ID NO: 862 - protein, 8 aa, Unknown
  resistance gene
MSPASTYK

SEQ ID NO: 863 - protein, 6 aa, Unknown
  resistance gene
MTAGGK

SEQ ID NO: 864 - protein, 5 aa, Unknown
  resistance gene
MVSGK

SEQ ID NO: 865 - protein, 10 aa, Unknown
  resistance gene
NEHDPVLPYR

SEQ ID NO: 866 - protein, 7 aa, Unknown
  resistance gene
NEHQIFK

SEQ ID NO: 867 - protein, 7 aa, Unknown
  resistance gene
NEHQVFK

SEQ ID NO: 868 - protein, 6 aa, Unknown
  resistance gene
NEITYK

SEQ ID NO: 869 - protein, 6 aa, Unknown
  resistance gene
NELLMK

SEQ ID NO: 870 - protein, 6 aa, Unknown
  resistance gene
NELMMK

SEQ ID NO: 871 - protein, 6 aa, Unknown
  resistance gene
NELPFR

SEQ ID NO: 872 - protein, 15 aa, Unknown
  resistance gene
NFILIFIFVILISCK

SEQ ID NO: 873 - protein, 15 aa, Unknown
  resistance gene
NFILIFIFVILTSCK

SEQ ID NO: 874 - protein, 11 aa, Unknown
  resistance gene
NISSYGNNLVR

SEQ ID NO: 875 - protein, 11 aa, Unknown
  resistance gene
NISTYGNNLTR

SEQ ID NO: 876 - protein, 15 aa, Unknown
  resistance gene
NLFNEVHTTGVLVIR

SEQ ID NO: 877 - protein, 11 aa, Unknown
  resistance gene
NLSTYGNALAR

SEQ ID NO: 878 - protein, 10 aa, Unknown
  resistance gene
NMENLELFGK

SEQ ID NO: 879 - protein, 12 aa, Unknown
  resistance gene
NMLLLEENNGYK

SEQ ID NO: 880 - protein, 12 aa, Unknown
  resistance gene
NMLLLEESNGYK

SEQ ID NO: 881 - protein, 7 aa, Unknown
  resistance gene
NMLLLEK

SEQ ID NO: 882 - protein, 9 aa, Unknown
  resistance gene
NMTLGDAMK

SEQ ID NO: 883 - protein, 14 aa, Unknown
  resistance gene
NNGLTEAWLESSLK

SEQ ID NO: 884 - protein, 6 aa, Unknown
  resistance gene
NQLPFK

SEQ ID NO: 885 - protein, 11 aa, Unknown
  resistance gene
NQLPFQVEHQR

SEQ ID NO: 886 - protein, 21 aa, Unknown
  resistance gene
NSAIENTIDNMYLQDLENSTK

SEQ ID NO: 887 - protein, 21 aa, Unknown
  resistance gene
NSAIENTIENMYLQDLDNSTK

SEQ ID NO: 888 - protein, 21 aa, Unknown
  resistance gene
NSAIENTIENMYLQDLENSTK

SEQ ID NO: 889 - protein, 12 aa, Unknown
  resistance gene
NSAVWVYELFAK

SEQ ID NO: 890 - protein, 8 aa, Unknown
  resistance gene
NSQVPAYK

SEQ ID NO: 891 - protein, 12 aa, Unknown
  resistance gene
NSTVWIYELFAK

SEQ ID NO: 892 - protein, 12 aa, Unknown
  resistance gene
NSTVWVYELFAK

SEQ ID NO: 893 - protein, 12 aa, Unknown
  resistance gene
NSTVWVYQLFAK

SEQ ID NO: 894 - protein, 12 aa, Unknown
  resistance gene
NTSGALVIQTDK

SEQ ID NO: 895 - protein, 12 aa, Unknown
  resistance gene
NTSGVLVIQTDK

SEQ ID NO: 896 - protein, 13 aa, Unknown
  resistance gene
NVDEMFYYYDGSK

SEQ ID NO: 897 - protein, 5 aa, Unknown
  resistance gene
NWILR

SEQ ID NO: 898 - protein, 9 aa, Unknown
  resistance gene
NWNAAMDLR

SEQ ID NO: 899 - protein, 17 aa, Unknown
  resistance gene
NYVDAFHYGNQDISGDK

SEQ ID NO: 900 - protein, 13 aa, Unknown
  resistance gene
QADHAILVFDQAR

SEQ ID NO: 901 - protein, 13 aa, Unknown
  resistance gene
QAEHALLVFGQER

SEQ ID NO: 902 - protein, 5 aa, Unknown
  resistance gene
QAITK

SEQ ID NO: 903 - protein, 14 aa, Unknown
  resistance gene
QAMLTEANSDYIIR

SEQ ID NO: 904 - protein, 11 aa, Unknown
  resistance gene
QEVQFVSALAR

SEQ ID NO: 905 - protein, 6 aa, Unknown
  resistance gene
QFASIK

SEQ ID NO: 906 - protein, 8 aa, Unknown
  resistance gene
QGMPGSIR

SEQ ID NO: 907 - protein, 8 aa, Unknown
  resistance gene
QGMSGSIR

SEQ ID NO: 908 - protein, 14 aa, Unknown
  resistance gene
QGQTQQSYGNDLAR

SEQ ID NO: 909 - protein, 13 aa, Unknown
  resistance gene
QIDYGNADPSTIK

SEQ ID NO: 910 - protein, 13 aa, Unknown
  resistance gene
QIDYGNVDPSTIK

SEQ ID NO: 911 - protein, 6 aa, Unknown
  resistance gene
QIGEAR

SEQ ID NO: 912 - protein, 6 aa, Unknown
  resistance gene
QIGQAR

SEQ ID NO: 913 - protein, 14 aa, Unknown
  resistance gene
QIMLIEQTPAFTLR

SEQ ID NO: 914 - protein, 12 aa, Unknown
  resistance gene
QLGSAIDQFWLR

SEQ ID NO: 915 - protein, 6 aa, Unknown
  resistance gene
QLHDNK

SEQ ID NO: 916 - protein, 11 aa, Unknown
  resistance gene
QLIFVHTVVQK

SEQ ID NO: 917 - protein, 14 aa, Unknown
  resistance gene
QLIFVHTVVQKPGK

SEQ ID NO: 918 - protein, 5 aa, Unknown
  resistance gene
QLPVK

SEQ ID NO: 919 - protein, 7 aa, Unknown
  resistance gene
QLPVKPR

SEQ ID NO: 920 - protein, 9 aa, Unknown
  resistance gene
QLSLDVLDK

SEQ ID NO: 921 - protein, 6 aa, Unknown
  resistance gene
QLVYAR

SEQ ID NO: 922 - protein, 14 aa, Unknown
  resistance gene
QMMLTEASTDYIIR

SEQ ID NO: 923 - protein, 16 aa, Unknown
  resistance gene
QMSIVEATPDYVLHGK

SEQ ID NO: 924 - protein, 7 aa, Unknown
  resistance gene
QPTDPAR

SEQ ID NO: 925 - protein, 7 aa, Unknown
  resistance gene
QPTDPTR

SEQ ID NO: 926 - protein, 8 aa, Unknown
  resistance gene
QPVSAGIR

SEQ ID NO: 927 - protein, 5 aa, Unknown
  resistance gene
QQLVK

SEQ ID NO: 928 - protein, 7 aa, Unknown
  resistance gene
QTLVFAR

SEQ ID NO: 929 - protein, 6 aa, Unknown
  resistance gene
QVGAEK

SEQ ID NO: 930 - protein, 6 aa, Unknown
  resistance gene
QVVFAR

SEQ ID NO: 931 - protein, 11 aa, Unknown
  resistance gene
SADEVLPYGGK

SEQ ID NO: 932 - protein, 14 aa, Unknown
  resistance gene
SADEVLPYGGKPQR

SEQ ID NO: 933 - protein, 9 aa, Unknown
  resistance gene
SCATNDLAR

SEQ ID NO: 934 - protein, 9 aa, Unknown
  resistance gene
SCATNNLAR

SEQ ID NO: 935 - protein, 8 aa, Unknown
  resistance gene
SDIPGGSK

SEQ ID NO: 936 - protein, 5 aa, Unknown
  resistance gene
SDWGK

SEQ ID NO: 937 - protein, 14 aa, Unknown
  resistance gene
SEDNFHISSQQHEK

SEQ ID NO: 938 - protein, 8 aa, Unknown
  resistance gene
SEMPASIR

SEQ ID NO: 939 - protein, 8 aa, Unknown
  resistance gene
SEMPASTR

SEQ ID NO: 940 - protein, 12 aa, Unknown
  resistance gene
SFAAHNQDQDLR

SEQ ID NO: 941 - protein, 7 aa, Unknown
  resistance gene
SFAGHNK

SEQ ID NO: 942 - protein, 12 aa, Unknown
  resistance gene
SFAGHNQDQDLR

SEQ ID NO: 943 - protein, 12 aa, Unknown
  resistance gene
SFAGHNQDQNLR

SEQ ID NO: 944 - protein, 8 aa, Unknown
  resistance gene
SFLESWAK

SEQ ID NO: 945 - protein, 7 aa, Unknown
  resistance gene
SFTAWEK

SEQ ID NO: 946 - protein, 7 aa, Unknown
  resistance gene
SFTTWEK

SEQ ID NO: 947 - protein, 7 aa, Unknown
  resistance gene
SGSGWLR

SEQ ID NO: 948 - protein, 20 aa, Unknown
  resistance gene
SGWGMAVDPQVGWYVGFVEK

SEQ ID NO: 949 - protein, 20 aa, Unknown
  resistance gene
SGWGMDVSPQVGWLTGWVEK

SEQ ID NO: 950 - protein, 20 aa, Unknown
  resistance gene
SGWGMDVTPQVGWLTGWVEK

SEQ ID NO: 951 - protein, 9 aa, Unknown
  resistance gene
SIHPASTFK

SEQ ID NO: 952 - protein, 5 aa, Unknown
  resistance gene
SIPTK

SEQ ID NO: 953 - protein, 5 aa, Unknown
  resistance gene
SISTK

SEQ ID NO: 954 - protein, 10 aa, Unknown
  resistance gene
SLGLSNNLSR

SEQ ID NO: 955 - protein, 7 aa, Unknown
  resistance gene
SLSMSGK

SEQ ID NO: 956 - protein, 8 aa, Unknown
  resistance gene
SMLFIEEK

SEQ ID NO: 957 - protein, 5 aa, Unknown
  resistance gene
SNGEK

SEQ ID NO: 958 - protein, 14 aa, Unknown
  resistance gene
SNGLTHSWLGSSLK

SEQ ID NO: 959 - protein, 5 aa, Unknown
  resistance gene
SNGYK

SEQ ID NO: 960 - protein, 7 aa, Unknown
  resistance gene
SPTWELK

SEQ ID NO: 961 - protein, 15 aa, Unknown
  resistance gene
SPTWELKPEYNPSPR

SEQ ID NO: 962 - protein, 6 aa, Unknown
  resistance gene
SQDIVR

SEQ ID NO: 963 - protein, 13 aa, Unknown
  resistance gene
SQQKPTDPTIWLK

SEQ ID NO: 964 - protein, 16 aa, Unknown
  resistance gene
SQVGWLTGWVEQPDGK

SEQ ID NO: 965 - protein, 13 aa, Unknown
  resistance gene
SSSNSCTTNNAAR

SEQ ID NO: 966 - protein, 13 aa, Unknown
  resistance gene
SSSNSCTTNNATR

SEQ ID NO: 967 - protein, 7 aa, Unknown
  resistance gene
SVYGELR

SEQ ID NO: 968 - protein, 5 aa, Unknown
  resistance gene
SWILR

SEQ ID NO: 969 - protein, 15 aa, Unknown
  resistance gene
SYFDEAQTQGVIIIK

SEQ ID NO: 970 - protein, 5 aa, Unknown
  resistance gene
SYLEK

SEQ ID NO: 971 - protein, 7 aa, Unknown
  resistance gene
SYPMWEK

SEQ ID NO: 972 - protein, 10 aa, Unknown
  resistance gene
TAYIPASTFK

SEQ ID NO: 973 - protein, 6 aa, Unknown
  resistance gene
TDDLFK

SEQ ID NO: 974 - protein, 8 aa, Unknown
  resistance gene
TDINEIFK

SEQ ID NO: 975 - protein, 8 aa, Unknown
  resistance gene
TFIHNDPR

SEQ ID NO: 976 - protein, 9 aa, Unknown
  resistance gene
TGAGFTANR

SEQ ID NO: 977 - protein, 8 aa, Unknown
  resistance gene
TGFNDGQK

SEQ ID NO: 978 - protein, 7 aa, Unknown
  resistance gene
TGLADSK

SEQ ID NO: 979 - protein, 8 aa, Unknown
  resistance gene
TGLDLMQK

SEQ ID NO: 980 - protein, 8 aa, Unknown
  resistance gene
TGLELMQK

SEQ ID NO: 981 - protein, 7 aa, Unknown
  resistance gene
TGMGYPK

SEQ ID NO: 982 - protein, 5 aa, Unknown
  resistance gene
TGNGR

SEQ ID NO: 983 - protein, 10 aa, Unknown
  resistance gene
TGTGSFIDAR

SEQ ID NO: 984 - protein, 10 aa, Unknown
  resistance gene
TGTGSLSDAK

SEQ ID NO: 985 - protein, 20 aa, Unknown
  resistance gene
TGVATEYQPEIGWWAGWVER

SEQ ID NO: 986 - protein, 13 aa, Unknown
  resistance gene
TGVSYPLLADGTR

SEQ ID NO: 987 - protein, 9 aa, Unknown
  resistance gene
TGWAAMDIK

SEQ ID NO: 988 - protein, 8 aa, Unknown
  resistance gene
TGWAMDIK

SEQ ID NO: 989 - protein, 8 aa, Unknown
  resistance gene
TGWAMDVK

SEQ ID NO: 990 - protein, 6 aa, Unknown
  resistance gene
TGWATR

SEQ ID NO: 991 - protein, 19 aa, Unknown
  resistance gene
TGWCFDCTPELGWWVGWVK

SEQ ID NO: 992 - protein, 6 aa, Unknown
  resistance gene
TGWEGR

SEQ ID NO: 993 - protein, 7 aa, Unknown
  resistance gene
TGWFVDK

SEQ ID NO: 994 - protein, 6 aa, Unknown
  resistance gene
TGYDTK

SEQ ID NO: 995 - protein, 6 aa, Unknown
  resistance gene
TGYGVR

SEQ ID NO: 996 - protein, 6 aa, Unknown
  resistance gene
TGYSAR

SEQ ID NO: 997 - protein, 6 aa, Unknown
  resistance gene
TGYSTR

SEQ ID NO: 998 - protein, 9 aa, Unknown
  resistance gene
THESSNWGK

SEQ ID NO: 999 - protein, 13 aa, Unknown
  resistance gene
TICTAIADAGTGK

SEQ ID NO: 1000 - protein, 20 aa, Unknown
  resistance gene
TIGGAPDAYWVDDSLQISAR

SEQ ID NO: 1001 - protein, 13 aa, Unknown
  resistance gene
TLPFSASSYETLR

SEQ ID NO: 1002 - protein, 7 aa, Unknown
  resistance gene
TLPFSLK

SEQ ID NO: 1003 - protein, 7 aa, Unknown
  resistance gene
TLPFSPK

SEQ ID NO: 1004 - protein, 21 aa, Unknown
  resistance gene
TLPFSQEVQDEVQSILFIEEK

SEQ ID NO: 1005 - protein, 21 aa, Unknown
  resistance gene
TLPFSQEVQDEVQSMLFIEEK

SEQ ID NO: 1006 - protein, 7 aa, Unknown
  resistance gene
TLPFSQK

SEQ ID NO: 1007 - protein, 7 aa, Unknown
  resistance gene
TLPSSQK

SEQ ID NO: 1008 - protein, 14 aa, Unknown
  resistance gene
TLQNGWFEGFIISK

SEQ ID NO: 1009 - protein, 8 aa, Unknown
  resistance gene
TMQEYLNK

SEQ ID NO: 1010 - protein, 13 aa, Unknown
  resistance gene
TNGNSTSVYNESR

SEQ ID NO: 1011 - protein, 11 aa, Unknown
  resistance gene
TQTYQAYDAAR

SEQ ID NO: 1012 - protein, 9 aa, Unknown
  resistance gene
TTDPTIWEK

SEQ ID NO: 1013 - protein, 8 aa, Unknown
  resistance gene
TTTTEVFK

SEQ ID NO: 1014 - protein, 9 aa, Unknown
  resistance gene
TWASNDFSR

SEQ ID NO: 1015 - protein, 7 aa, Unknown
  resistance gene
TWDMVQR

SEQ ID NO: 1016 - protein, 17 aa, Unknown
  resistance gene
TWMQFSVVWVSQEITQK

SEQ ID NO: 1017 - protein, 7 aa, Unknown
  resistance gene
TYPMWEK

SEQ ID NO: 1018 - protein, 8 aa, Unknown
  resistance gene
TYVVDPAR

SEQ ID NO: 1019 - protein, 10 aa, Unknown
  resistance gene
VAFSLNIEMK

SEQ ID NO: 1020 - protein, 14 aa, Unknown
  resistance gene
VANSLIGLSTGAVR

SEQ ID NO: 1021 - protein, 5 aa, Unknown
  resistance gene
VEHQR

SEQ ID NO: 1022 - protein, 5 aa, Unknown
  resistance gene
VELGK

SEQ ID NO: 1023 - protein, 20 aa, Unknown
  resistance gene
VFDDAGVSGTFVLMDITADR

SEQ ID NO: 1024 - protein, 8 aa, Unknown
  resistance gene
VFLDSWAK

SEQ ID NO: 1025 - protein, 8 aa, Unknown
  resistance gene
VFLESWAK

SEQ ID NO: 1026 - protein, 17 aa, Unknown
  resistance gene
VFLSSWAQDMNLSSAIK

SEQ ID NO: 1027 - protein, 5 aa, Unknown
  resistance gene
VGFER

SEQ ID NO: 1028 - protein, 9 aa, Unknown
  resistance gene
VILVFDQVR

SEQ ID NO: 1029 - protein, 6 aa, Unknown
  resistance gene
VITFTK

SEQ ID NO: 1030 - protein, 7 aa, Unknown
  resistance gene
VMAAMVR

SEQ ID NO: 1031 - protein, 20 aa, Unknown
  resistance gene
VPLAVMGYDAGILVDAHNPR

SEQ ID NO: 1032 - protein, 6 aa, Unknown
  resistance gene
VQANVK

SEQ ID NO: 1033 - protein, 6 aa, Unknown
  resistance gene
VQDEVK

SEQ ID NO: 1034 - protein, 14 aa, Unknown
  resistance gene
VQDEVQSMLFIEEK

SEQ ID NO: 1035 - protein, 18 aa, Unknown
  resistance gene
VQDEVQSMLFIEEMNGNK

SEQ ID NO: 1036 - protein, 14 aa, Unknown
  resistance gene
VQDGVQSMLFIEEK

SEQ ID NO: 1037 - protein, 14 aa, Unknown
  resistance gene
VQHEVQSMLFIEEK

SEQ ID NO: 1038 - protein, 13 aa, Unknown
  resistance gene
VSCLPCYQVVSHK

SEQ ID NO: 1039 - protein, 12 aa, Unknown
  resistance gene
VSCVWCYQALAR

SEQ ID NO: 1040 - protein, 17 aa, Unknown
  resistance gene
VSDVCSEVTAEGWQEVR

SEQ ID NO: 1041 - protein, 12 aa, Unknown
  resistance gene
VSEVEGWQIHGK

SEQ ID NO: 1042 - protein, 10 aa, Unknown
  resistance gene
VSFSLNIEMK

SEQ ID NO: 1043 - protein, 8 aa, Unknown
  resistance gene
VSPCSSFK

SEQ ID NO: 1044 - protein, 8 aa, Unknown
  resistance gene
VSQVPAYK

SEQ ID NO: 1045 - protein, 5 aa, Unknown
  resistance gene
VVFAR

SEQ ID NO: 1046 - protein, 5 aa, Unknown
  resistance gene
WDGAK

SEQ ID NO: 1047 - protein, 5 aa, Unknown
  resistance gene
WDGEK

SEQ ID NO: 1048 - protein, 13 aa, Unknown
  resistance gene
WDGHIYDFPDWNR

SEQ ID NO: 1049 - protein, 5 aa, Unknown
  resistance gene
WDGIK

SEQ ID NO: 1050 - protein, 6 aa, Unknown
  resistance gene
WDGKPR

SEQ ID NO: 1051 - protein, 5 aa, Unknown
  resistance gene
WDGQK

SEQ ID NO: 1052 - protein, 6 aa, Unknown
  resistance gene
WDGQTR

SEQ ID NO: 1053 - protein, 5 aa, Unknown
  resistance gene
WDGVK

SEQ ID NO: 1054 - protein, 6 aa, Unknown
  resistance gene
WDGVNR

SEQ ID NO: 1055 - protein, 11 aa, Unknown
  resistance gene
WDYKPEFNGYK

SEQ ID NO: 1056 - protein, 21 aa, Unknown
  resistance gene
WETYSVVWFSQQITEWLGMER

SEQ ID NO: 1057 - protein, 5 aa, Unknown
  resistance gene
WNGQK

SEQ ID NO: 1058 - protein, 5 aa, Unknown
  resistance gene
YAQAK

SEQ ID NO: 1059 - protein, 8 aa, Unknown
  resistance gene
YFSDFNAK

SEQ ID NO: 1060 - protein, 7 aa, Unknown
  resistance gene
YGTHLDR

SEQ ID NO: 1061 - protein, 6 aa, Unknown
  resistance gene
YIIHNK

SEQ ID NO: 1062 - protein, 7 aa, Unknown
  resistance gene
YLDELVK

SEQ ID NO: 1063 - protein, 9 aa, Unknown
  resistance gene
YLMITEAGR

SEQ ID NO: 1064 - protein, 18 aa, Unknown
  resistance gene
YLNLFSYGNANIGGGIDK

SEQ ID NO: 1065 - protein, 5 aa, Unknown
  resistance gene
YNGEK

SEQ ID NO: 1066 - protein, 6 aa, Unknown
  resistance gene
YPHNPR

SEQ ID NO: 1067 - protein, 18 aa, Unknown
  resistance gene
YPVVWYSQQVAHHLGAQR

SEQ ID NO: 1068 - protein, 8 aa, Unknown
  resistance gene
YSNVLAFK

SEQ ID NO: 1069 - protein, 8 aa, Unknown
  resistance gene
YSPASTFK

SEQ ID NO: 1070 - protein, 12 aa, Unknown
  resistance gene
YSVVPVYQQLAR

SEQ ID NO: 1071 - protein, 12 aa, Unknown
  resistance gene
YSVVWYSQLTAK

SEQ ID NO: 1072 - protein, 18 aa, Unknown
  resistance gene
YSVVWYSQQVAHHLGAQR

SEQ ID NO: 1073 - protein, 8 aa, Unknown
  resistance gene
YTPASTFK

SEQ ID NO: 1074 - protein, 18 aa, Unknown
  resistance gene
YTSAFGYGNADVSGEPGK

SEQ ID NO: 1075 - protein, 20 aa, Unknown
  resistance gene
YVFVSALTGNLGSNLTSSIK

SEQ ID NO: 1076 - protein, 20 aa, Unknown
  resistance gene
YVFVSALTGSLGSNLTSSIK

SEQ ID NO: 1077 - protein, 6 aa, Unknown
  resistance gene
YVGHDR

SEQ ID NO: 1078 - protein, 270 aa, Unknown
  resistance gene
MELPNIMHPVAKLSTALAAALMLSGCMAGEIRPTIGQQMETGDQRFGDLVFRQLAPNVWQHTSYLDMPGFGAVASNGLIVRDGGRVLVVDTAWTDDQTAQILNWIKQEINLPVALAVVTHAHQDKMGGMDALHAAGIATYANALSNQLAPQEGMVAAQHSLTFAANGWVEPATAPNFGPLKVFYPGPGHTSDNITVGIDGTDIAFGGCLIKDSKAKSLGNLGDADTEHYAASARAFGAAFPKASMIVMSHSAPDSRAAITHTARMADKLR

SEQ ID NO: 1079 - protein, 270 aa, Unknown
  resistance gene
MELPNIMHPVAKLSTALAAALMLSGCMPGEIRPTIGQQMETGDQRFGDLVFRQLAPNVWQHTSYLDMPGFGAVASNGLIVRDGGRVLLVDTAWTDDQTAQILNWIKQEINLPVALAVVTHAHQDKMGGMDALHAAGIATYANALSNQLAPQEGLVAAQHSLTFAANGWVEPATAPNFGPLKVFYPGPGHTSDNITVGIDGTDIAFGGCLIKDSKAKSLGNLGDADTEHYAASARAFGAAFPKASMIVMSHSAPDSRAAITHTARMADKLR

SEQ ID NO: 1080 - protein, 270 aa, Unknown
  resistance gene
MELPNIMHPVAKLSTALAAALMLSGCMPGEIRPTIGQQMETGDQRFGDLVFRQLAPNVWQHTSYLDMPGFGAVASNGLIVRDGGRVLVVDTAWTDDQTAQILNWIKQEINLPVALAVVTHAHQDKMGGMDALHAAGIATYANALSNQLAPQEGMVAAQHSLTFAANGWVEPATAPNFGPLKVFYPGPGHTSDNITVGIDGTDIAFGGCLIKDSKAKSLGNLGDADTEHYAASARAFGAAFPKASMIVMSHSAPDSRAAITHTARMADKLR

SEQ ID NO: 1081 - protein, 20 aa, Unknown
  resistance gene
LSTALAAALMLSGCMAGEIR

SEQ ID NO: 1082 - protein, 20 aa, Unknown
  resistance gene
LSTALAAALMLSGCMPGEIR

SEQ ID NO: 1083 - protein, 21 aa, Unknown
  resistance gene
VLLVDTAWTDDQTAQILNWIK

SEQ ID NO: 1084 - protein, 293 aa, Unknown; identical to SEQ ID NO: 14
  resistance gene

SEQ ID NO: 1085 - protein, 293 aa, Unknown; identical to SEQ ID NO: 16
  resistance gene

SEQ ID NO: 1086 - protein, 293 aa, Unknown; identical to SEQ ID NO: 10
  resistance gene

SEQ ID NO: 1087 - protein, 293 aa, Unknown; identical to SEQ ID NO: 11
  resistance gene

SEQ ID NO: 1088 - protein, 293 aa, Unknown
  resistance gene
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVPWSPISEKYLTTGMTVAELSAAAVQYSDNAAANLLLKELGGPAGLTAFMRSIGDTTFRLDRWELELNSAIPSDARDTSSPRAVTESLQKLTLGSALAAPQRQQFVDWLKGNTTGNHRIRAAVPADWAVGDKTGTCGVYGTANDYAVVWPTGRAPIVLAVYTRAPNKDDKHSEAVIAAAARLALEGLGVNGQ

SEQ ID NO: 1089 - protein, 293 aa, Unknown
  resistance gene
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVPWSPISEKYLTTGMTVAELSAAAVQYSDNAAANLLLKELGGPAGLTAFMRSIGDTTFRLDRWELEMNSAIPGDARDTSSPRAVTESLQKLTLGSALAAPQRQQFVDWLKGNTTGNHRIRAAVPADWAVGDKTGTCGVYGTANDYAVVWPTGRAPIVLAVYTRAPNKDDKHSEAVIAAAARLALEGLGVNGQ

SEQ ID NO: 1090 - protein, 293 aa, Unknown; identical to SEQ ID NO: 13
  resistance gene

SEQ ID NO: 1091 - protein, 293 aa, Unknown; identical to SEQ ID NO: 18
  resistance gene

SEQ ID NO: 1092 - protein, 284 aa, Unknown
  resistance gene
RLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVPWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGAYGTANDYAVVWPTGRAPIVLAVYTRAPNKDDKYSEAVIAAAARLALEGLG

SEQ ID NO: 1093 - protein, 292 aa, Unknown
  resistance gene
SLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVRWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGGYGTANDYAVVWPTGRAPIVLAVYTRAPNKDDKHSEAVIAAAARLALEGLGVNGQ

SEQ ID NO: 1094 - protein, 5 aa, Unknown
  resistance gene
NALVR

SEQ ID NO: 1095 - protein, 21 aa, Unknown
  resistance gene
TGTCGAYGTANDYAVVWPTGR

SEQ ID NO: 1096 - protein, 14 aa, Unknown
  resistance gene
WELELNSAIPSDAR

SEQ ID NO: 1097 - protein, 14 aa, Unknown
  resistance gene
WELEMNSAIPGDAR

SEQ ID NO: 1098 - protein, 12 aa, Unknown
  resistance gene
ANQAFLPASTFK

SEQ ID NO: 1099 - protein, 7 aa, Unknown
  resistance gene
DEHQVFK

SEQ ID NO: 1100 - protein, 9 aa, Unknown
  resistance gene
DHNLITAMK

SEQ ID NO: 1101 - protein, 7 aa, Unknown
  resistance gene
DIATWNR

SEQ ID NO: 1102 - protein, 14 aa, Unknown
  resistance gene
IPNSLIALDLGVVK

SEQ ID NO: 1103 - protein, 11 aa, Unknown
  resistance gene
ISATEQISFLR

SEQ ID NO: 1104 - protein, 14 aa, Unknown
  resistance gene
QAMLTEANGDYIIR

SEQ ID NO: 1105 - protein, 9 aa, Unknown
  resistance gene
QQGFTNNLK

SEQ ID NO: 1106 - protein, 12 aa, Unknown
  resistance gene
SQGVVVLWNENK

SEQ ID NO: 1107 - protein, 10 aa, Unknown
  resistance gene
SWNAHFTEHK

SEQ ID NO: 1108 - protein, 21 aa, Unknown
  resistance gene
VLALSAVFLVASIIGMPAVAK

SEQ ID NO: 1109 - protein, 12 aa, Unknown
  resistance gene
YSVVPVYQEFAR

The invention claimed is:

1. A method of detecting a KPC protein in a sample from a microorganism, the method comprising:
   subjecting the sample to MS/MS spectrometry in MRM mode and detecting whether one or more KPC fragments selected from the group consisting of SEQ ID NOS: 20-33, 1094, 1096, and 1097 is present, wherein detection of any of the KPC fragments by the MRM mass spectrometry indicates the presence of KPC protein in the sample.

2. The detection method according to claim 1, further comprising:
   before performing MS/MS spectrometry in MRM mode, digesting proteins to produce peptides in the sample.

3. The detection method according to claim 2, wherein the digestion is performed by an enzyme.

4. The detection method according to claim 3, wherein the enzyme is trypsin.

5. The detection method according to claim 1, wherein the one or more KPC fragments is selected from the group consisting of SEQ ID NOS: 21, 23, 25, 28, 29, 31, and 32.

6. The detection method according to claim 1, further comprising performing MS/MS spectrometry in MRM mode on the sample to determine whether the sample includes NDM, GES, IMP, IND, SME, VIM, and OXA.

7. A method of detecting a KPC protein in a sample from a microorganism, the method comprising:
   subjecting the sample to targeted mass spectrometry and detecting whether one or more KPC fragments selected from the group consisting of SEQ ID NOS: 20-33, 1094, 1096, and 1097 is present, wherein detection of any of the KPC fragments by the targeted mass spectrometry indicates the presence of KPC protein in the sample.

* * * * *